United States Patent 7,700,359 (GENE PRODUCTS DIFFERENTIALLY EXPRESSED IN CANCEROUS CELLS) - sequence listing, part 3

SEQ ID NO: 11206 - DNA, 394 bp, Homo sapiens
  misc_feature 104, 197: n = A,T,C or G
gttgatgtgacaaacagcatttattccagactccagtgtccacagatgatggggtggggcggaggtagggcgggggcaggagtgggaccaggggcggggtgagnggggggaatccagtgtcagactctgcagcaagacgtcaggtggggggaccagcaagggaggcgggaggtaaaaatagctccggccagccgacnccctgagccttgtcccaggctgggccttgggcttgggtccaggagctattctggggcctgggagagtcacattccctggagggagggcccctccacccacccaccctccctctccttccctcccggaggcaggcagccacttggggtccctgccttgcccgcagaggaaggaagggagggctgggcaaggagaggga

SEQ ID NO: 11207 - DNA, 635 bp, Homo sapiens
ttttagcaatgacattaacaagattttgccaggttataaaaatgagggctttcttgagaattacttatagtttccgagttgaatggcagagcgcacgtagacacatctgaaggtggatggctgtatctcccagtactggaccgggttgctgaaaagactcacacccgaataagaagcctttttggtgttgtgtccaggtgggcagaagtcacttgatccaactacagagatattgttgttatgaaggtagacaacctggatgtacttatgctctgccagcccaccaggtactctggtaagcttgttgttgtccaagtgaagctccctcagatgaggcgtgttggccagagagccattgtcaacagcagagatgctgttgaaactcaatcccaacttagccaaattattcagtcctttcaggctagctgcatcaactctgctgatttgttgccatcaagatgtaattccgtaagggaaggaggaagaccttgaggaatgctggtgatattgtatcagcaatgcggatgtaggagagcttcttcattccctgaaaagccccattttcaattcctgagctcttaagcgggatggtggcccagtctatgacaattcatctggtcagtccatttaaagta

SEQ ID NO: 11208 - DNA, 516 bp, Homo sapiens
tgacactatagaacaagtttgtacaaaaaacaggctggtaccggtccggaattcccgggatatcgtcgacccacgcgtccggtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaagcctccttcggccttcttcctcttctgctctgagtatcgcccaaaaatcaaa

SEQ ID NO: 11209 - DNA, 616 bp, Homo sapiens
  misc_feature 538: n = A,T,C or G
aagtttgtacaaaaaagcagctggtaccggtccggaattcccgggatatcgtcgacccacgcgtccgagctggtgttcctctttattggctcagacgctttcaactgctgtacttttctctctggcttcttgctattggctgggactcaagatggaaacatttatcagctggatgtgaggagtccaagggctccggtacaagtcatccacagatcaggagcaccagttctatccctgctaagtgtcagagatggattcattgctagccaaggtgatggaagctgttttattgtccagcaagacttagactatgtcactgagctcactggggctgactgtgaccctgtgtacaaggtagccacatgggagaagcagatctacacatgctgtcgagacggtcttgtacgacgctaccagctttctgacctctgacttcttggaaagagcagtcccggttagtgaaaaggtttgaccctgatcaacaatgagcagaaacatcatcagtccttcccaaggaccatggcgtttaatgtcttgngcaccccttggaaatacagaaagtcagctgtactggccgtgtggaactctcatcccaagacctactttgaactgagta

SEQ ID NO: 11210 - DNA, 111 bp, Homo sapiens
ggggggcttccctgagggggggggggctccccttccccctttttttttggggccctaaaaaagggtttttaaccccggggccccccccccaaatttttggcctttttaaaa

SEQ ID NO: 11211 - DNA, 753 bp, Homo sapiens
  misc_feature 582, 704: n = A,T,C or G
tttcttgatcaacatttttattttatttttttaggtgaagtagaacacaatagaatggctcaaaaatatcagaatgcactacgcacatcacgagtaaatactgtttggtaaaacttgtttcagttaaatatgtacgtgtccgtgcatgtcatgattaaatatccttcttaccacagtcaccctaaagaaccaaagcttaggactagggacacaaccatgcagaaagagcagggagaccagacactctgggttgagatgatgaatttaatgccgcagccgacacccacattcacactttggctccttcagacaacttgatctttgggactagaatttgtacagagtcaaacaccacatagaagcacgtggccgccacacacaacactcctttttagtgagagggacaagatacctatgtctcatgatcaaagtactcttttattcttaaataaaaatcttaatttgctttgacctccaaaggctctaatcccagtctccaaattcgtctcaagggatgttctcttcatgtggggccggtttaaacagaggctgcctcaccagagcagcctttcagtcctgcangtgtctctaatccatggtatgtacatgtcagtttgtgcaggcagggaacacacatgacagagaactactttggtgtacttggacgggtgtgttcttcactggattttgtgactgcttcatgnatgacgtgccacgtaatctatattttgtggttagccactccgttgattc

SEQ ID NO: 11212 - DNA, 484 bp, Homo sapiens
gccaccacagagcagaataggttaccggaattcattgagacaaactaacaaaactaaacagtcatgcccatttggaagagtcccagttaaccttctaaatagcccagattgtgatgtgaagacagatgattcagttgtaccttgttttatgaaaagacaaacctctagatcagaatgccgagatttggttgtgcctggatctaaaccaagtggaaatgattcctgtgaattaagaaatttaaagtctgttcaaaatagtcatttcaaggaacctctggtgtcagatgaaaagagttctgaacttattattactgattcaataaccctgaagaataaaacggaatcaagtcttctagctaaattagaagaaactaaagagtatcaagaaccagaggttccagagagtaaccagaaacagtggcaatctaagagaaagtcagagtgtattaaccagaatcctgctgcatcttcaaatcactggcag

SEQ ID NO: 11213 - DNA, 513 bp, Homo sapiens
agcgctcaaaaagatgcccaacgtcttccagaatctggtctcttgcaaaagggtcttccgggaattgaagatgttgtgtttttttaagcatgataatgtactctctgcccttgacatactctaacctccacacattgactattttgaagaaatatatgttgtcacagaattgatgcagagtgacctacataaaattatcgtctctcctcaaccactcagctcagatcatgtcaaagtttttctttatcagattttgcgaggtttgaaatatctccattcagctggcattttacatcgagacattaagccagggaatctccttgtgaacagcaactgtgttctaaagatttgtgattttggattggccagagtggaagaattagatgaatcccgtcatatgactcaggaagttgttactcagtattatcgggctccagaaatcctgatgggcagccgtcattacagcaatgctattgacatctggtctgtgggatgtatctttgcagaactact

SEQ ID NO: 11214 - DNA, 577 bp, Homo sapiens
tcggcacgaggtcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctgagatccccaaggcctttcctacatgccccctcccttcacaggggtacagaaattatccccctacaaccccagcctcctgagggctccatgctgaaggctcccattttcagttccctcctgcccaggactgcattgttttctagccccgaggtggtggcacgggccctccctcccagcgctctgggagccacgcctatgccctgcccttcctcagggcccctggggatcttgccccctttgaccttccccaaaggatggtcacacaccagcactttatacacttctggctccaggaaagtgtctgcagtaggggacccagagtcccaggcccctggagttgttttcggcaggggccttgtctctcactgcatttggtcaggggggcatgaataaaggctaca

SEQ ID NO: 11215 - DNA, 612 bp, Homo sapiens
  misc_feature 3, 550, 566, 569, 572, 575, 576, 586, 600, 610, 611: n = A,T,C or G
agnacgacagaaggggtgcacgtccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtgtacatgaaggtggacggagaggtactgaggacaaatcagttctctgtgaccagacatgagaaggttgccaatgggctgttgggcgaccaaggccttcccggagtcttcgtcctctatgagctctcgcccatgatggtgaagctgacggagaagcacaggtccttcacccacttcctgacaggtgtgtgcgccatcattgggggcatgttcacagtggctggactcatcgattcgctcatctaccactcagcacgagccatccagaagaaaattgatctagggaagacaacgtagtcaccctcggtgcttcctctgtctcctctttctccctggcctgtggttgtcccccagcctntgccaccctccacctnctnggncanncccaccccangatgataatctatngattgattgnna

SEQ ID NO: 11216 - DNA, 660 bp, Homo sapiens
  misc_feature 563, 626, 640: n = A,T,C or G
cacaagctcttttccagcagcttgttaaattccttgacttggagtagcctgactcttgtatggacctctagtgtcttgtcccctctgtgctctcccagtcctccctccctctcttttcattatgtagcttagataccggctccgtctccagcacccttccaagttctgtttttctggggtttttttgagacagagtttcactcttattgcccaggctggagtgcaatggcgcgatcttggctcactgcaacctccacctcccagattcaagcaattctcctcctcagcctcctgagtagctgggattacaggcatgtgctaccatgcccggctaattttgtatttttagtagagacggggtttctccatgttgatcaggctggtcttgaactcccaacctcaggtgggcagatctttggggggctgatgtgggtggattgcttgagcccaggaattcgagaccagcctgggcaacagagcaagacctcgcctctacaaaaaatgtaaaaagttagctgggcgtggtggtgtgtgcttgtaatcccagctgctctggaggctanggtaggaagattgcttgagcccacgagtcaaggctccaggagctatgaccatacatgccgtgncttccagcctgagngcaaagcagagctggctcac

SEQ ID NO: 11217 - DNA, 232 bp, Homo sapiens
  misc_feature 13, 16, 40, 41, 61, 67, 68, 70, 71, 98, 107, 125, 142, 143,148, 156, 160, 162, 164, 165, 177, 192, 195, 205, 209, 218,225: n = A,T,C or G
ggtacggctgctnttnttacgacagatggtacggctgctnntatgaccacagaagggtacngctgcnntnntaccacagaagggtacggctgctattnttaccacanaagggtacggctgctttnttacgacagaaggggtnntcccntctttttnggangncnnggcgggtggccnttttaggtcaggagntcnagacctcctntccnacatggtgnaaccctntctctct

SEQ ID NO: 11218 - DNA, 687 bp, Homo sapiens
  misc_feature 601: n = A,T,C or G
atttttaaatattgtattttcctgttctttgtgaaaacatcaataaatatcgaaacctctctgctctaacacagagggaaacactgcataattaacattaaacaaggcagtatgccttacaagaaagacataaaatgtccaagggatatttagaacattttagttcttaaagcttcaacatgagaaatgttgaccacacactgtgaaatcatttcaataaataacaactgacattcatctttacagttacaaaatagacacacatacatttccctgccgtcacattgatcttactggccattgtcttggattcctcagcctctatcacagtggctgacatgtgatatgtcatcacgaagaaatattaacaaatgactagagaatatctgcaaaccttctatcttcaaattaaatatgaatcaggattgaactaacttgggtttgacctaaaataaacaataaatataatgggagagtgtgcaagtagattcaatcataaccttattttacacataaaatattaacatagaatcttctaaaacaaacaaatgaatgaataaatcaatgaataaatagaagacttctcctaagtgatgctcanacacattaggcgcaatccaggtgggcctctgcaagctggtctctttatacttcttctgatcctgtaagggcaggccttctttagga

SEQ ID NO: 11219 - DNA, 560 bp, Homo sapiens
tgacactatagaacaagtttgtacaaaaaagcagctggtaccggtccggaattcccgggatatcgtcgacccacgcgtccgttggctaagatgaagtgaaaaatgatcaagctattttacatccttttttcatgctgagtgtttgagatctgatgtgtattttacacttacagcacatctcagtttggactagccacatttcaagtgctcagtagccgcgtatggccctatgttggacagcatgcatctaaactaggacttagggaaggggagtctctgatcctcatcctagcaacagccacagttattttttactgggatttttggcatttttacatgtgttagttaatgttactactctgtctccatcacccagtctagtgcctgacacctaacagcaagaatgtaatctgctgtcttaaagcagcacttaactatttgtattattgatgcctaaaccaagaagttctaaatatttatatatatggtatgatgaatggattttttttgtcttcatctattaaaagcaaaaaacaatttcatgtgtatatgatatttat

SEQ ID NO: 11220 - DNA, 602 bp, Homo sapiens
  misc_feature 302, 552, 600: n = A,T,C or G
atatacgaattaaaatttatttcaaactgttttgtacatctttttaaaaaatgaaaattcaaaagtcttagaattaagcaatgagtctttgatatcataaagctgtgtataacaataattaaagtagtggtaacattttacccttgtaaaaatgtcacagaattaaaatctcaacttggatcctcaatgattcaactggtttatcttacacaataagcgtttggtcagtttcaagataaaatttccccagacatgctgtccttaagtccttcctcctcaccatccatcagctcacacattgnggtagctggctgctgtggcgattccacagtggttgttcttgtctttggctatttttacatagccattcgagccccattctggaccccagctgtttttgacgagccaatacttgctgttattcgaatttgctccttcaaagccgtagccaaccaccagaacaccatgatccaggtttttgctgctgcagtctggttcaaaataaatgcctgatttgtagaactggaaggacgaatggcctgcatccatagncacggagatgggccccacagttgcgactgctttcatcagggccttctnct

SEQ ID NO: 11221 - DNA, 416 bp, Homo sapiens
cggcacgaggtggacacaccgactcggctgaggctgccccaggaaccataaggggtgacttcagcgtccacatcagcaggaatgtcatccacgccagcgactccgtggagggggcccagcgggagatccagctgtggttccagagcagtgagctggtgagctgggcagacgggggccagcacagcagcatccacccagcctgaggctcaagctgcccttaccaccccatcccccacgcaggaccaactacctccgtcagcaagaacccaagcccacatccaaacctgcctgtcccaaaccacttacttccctgttcacctctgccccaccccagcccagaggagtttgagccaccaacttcagtgcctttctgtaccccaagccagcacaagattggaccaatcctttttgcacca

SEQ ID NO: 11222 - DNA, 98 bp, Homo sapiens
ctatttaggtgacactatagaaacagtttgtacaaaaaacaggctggtaccggtccggaattcccgggatatcgtcgacccacgcgtccggccactcg

SEQ ID NO: 11223 - DNA, 598 bp, Homo sapiens
  misc_feature 561: n = A,T,C or G
accaacagtagggcagtgcattttatattacaactggtttcttgctctagtaggcttggggatgggtgaagacggacagggctggcgcagaccctttccttctcctctccagcccacagagatctgggcttttacaagacagcctgcttccattcagtagtgtgggaaagttccttcttggcttagcaatacccctgagaccttgttcagtgggctgtgtctctccctgggatgctgggagcaccaagtgtggccgagctagggctgctgacttcctctgggcgcctctgggctgcgagggtctcttacaggaattgaggccctttgctgctccaagaaatgctgaggctgtgggcagaggggtgtacccaaggggactcttgctctgtgtctgacttttggggatccccaggtgggcagggcaggaaggaagcggctcccagcactgcaaaggggcagcagcattacagctcagccttccagacattgtagatccagttgagataggctgagacacttgtgtatactcccctgggtgctcgggccccccgcagccatagncccagcttacgatgcccaccacatgccactggtcagg

SEQ ID NO: 11224 - DNA, 743 bp, Homo sapiens
  misc_feature 512, 622, 623, 700: n = A,T,C or G
tttgcttataaacatcctttattgtacatagacagtggatactgagaatgatcaagtaaatggaattttgaacaggtaaagaggaaacaaagaattaaggtatccctgtggaatagtgcaagaaaggagtgccccacccatagtgttatctacaataggtactccggggaaaggaccccaaggagtcagaccacaaatgtatgaccagcacaattctatgatcaaactctacctctagcaaggcgtctcaacaatcaagttctatttaaatcattcgctcgtgtcttctttcagtcatgatgaaataatgagaatatcataaggaacagaaggtaatgcattggtcaccacccttggagaggctggtgggatgtatctggattagtcctcacggggggtgctattttcctgcatagtcttcattatccagtcaacatagttctttacccgtgtgtagagcccataggtcccacactggggcccccaggacaccaggccagctgcgtagaatntggtcttgtcatttggatcctgtacagcaaaggccccaccactgtcccctttacagctatccatgcccttctctcctccagcacagatcatgtttagagtgaaaacatanngcctctgcatctgcttgtggttttctcactttcacttctttgcattttcttaaaagagcctcaggtaaccttgccgncttgaggcgaaacagacgatctcttcctctctgtccgccccca

SEQ ID NO: 11225 - DNA, 516 bp, Homo sapiens
  misc_feature 449: n = A,T,C or G
tcggcacgaggaccgcgctctacttcctgatccgggcgtttaggttgaagaagcctcagcggaggcgatacggcctcctcgccaacactgaggaccccacggagatggcctcgctggacagcgacgaggagacggtgtttgagtcccggaatctgagatgatgctgagccagggaggcggcccttccagcagccatgagggaaggacaggagatggggcccaccccagtgcccagcaaccccctgctccaccgctcattcccctgctggccccggggctggtctcacccagtgccaacccgagagctccttttggaacctgcacagcccgccgacctgttgccacctgcacccaccgctggaccatgcagcctcgcctcctggatgctgtcccagcctggccgagggtcccaggtgaagactggagggaccccaacagccaccgcccangacgctgaggctcccttgcctgactgtgacttgtgcctctctcctgcccccgtggggacatggcagc

SEQ ID NO: 11226 - DNA, 554 bp, Homo sapiens
  misc_feature 323: n = A,T,C or G
tttgtacaaaaaacaggctggtaccggtccggaattcccgggatatcgtcgacccacgcgtccgaataaagccacctggaaacacgaattctctatggctgcatccagctcaggaaacctcccaaggctatgtaaatagaggactcaggtgcctgtcactttccagccaagcaaatttaaatactgacagacacattttaacagattcagttacttcacagtttggtaaactataatcgcaatttgctccttataacctcttagtaaattattcatctccagtgggggaagactgatgtaatgatctcactttcctaccttangtgtttcatcagtacagacgcctcaccttcccacgcacgcagactcgcagacgccctctgctggaactgacacgcagacattcagcggctccgccgccaatgcaaaactcaaccctaccccaggcagcaatgctatctcagatgcctaccttaatgcctctgaacaaccactctgagcccttctggaagcgctgtcatttcaaccacaacaatactactactccatctaag

SEQ ID NO: 11227 - DNA, 539 bp, Homo sapiens
gtctggctcacctggaggaagaggtccacgacaaggtggttgcccgggacctggttggagccatgttgagcccactgccgcagccacgcccctctgccccccaggtgctggcccaccccttcttttggagcagagccaagcaactccagttcttccaggacgtcagtgactggctggagaaggagtccgagcaggagcccctggtgagggcactggaggcgggaggctgcgcagtggtccgggacaactggcacgagcacatctccatgccgctgcagacagatctgagaaagttccggtcctataaggggacatcagtgcgagacctgctccgtgctgtgaggaacaagaagcaccactacagggagctcccagttgaggtgcgacaggcactcggccaagtccctgatggcttcgtccagtacttcacaaaccgcttcccacggctgctcctccacacgcaccgagccatgaggagctgcgcctctgagagcctcttcctgccctactacccgccagactcagaggccaggaagcca

SEQ ID NO: 11228 - DNA, 454 bp, Homo sapiens
  misc_feature 152, 153, 154, 242, 414, 433, 450: n = A,T,C or G
gtcttttaaaaacatcgtaacattaacacatggccgttcaccgtcccccagcgatgggagctggcctgggccagggtcctccaggatcttcactcattcacagtaacggttctgaccagtcctccaggtcgcacgtggatgcgacaggggtnnngagggaggaggaagtgactgtcccacctctgcaggaccatgggagtgggcaaggtgttctccggggcgcacccctgaacccaggggtnttgcaggacttgggcggcactcagcctctgcttggcgtcacggaccagcagcttggagatgaggtctttggcagcgcaggaagatgtgggcccagtccttgtcggggaactcgtacttgccctcctggatgctctcaaacagcatgttctggcaggcagggcaggcctcgcngcgggtcccagccgcagtngctgccacagcggcccncgaa

SEQ ID NO: 11229 - DNA, 487 bp, Homo sapiens
cggcacgaggcctgacttgaaatctcagcccagtgctgagtctctagtgaactaagctcctacaccatcgggctggacctgcacagtcttgaggccgaccaagagccagggagccagatggtggaggccagcctctccgtacggcacccagagtacaacagacccttgctcgctaacgacctcatgctcatcaagttggacgaatccgtgtccgagtctgacaccatccggagcatcagcattgcttcgcagtgccctaccgcggggaactcttgcctcgtttctggctggggtctgctggcgaacggcagaatgcctaccgtgctgcagtgcgtgaacgtgtcggtggtgtctgaggaggtctgcagtaagctctatgacccgctgtaccaccccagcatgttctgcgccggcggagggcaagaccagaaggactcctgcaacggtgactctggggggcccctgatctgcaacgggtacttgcagg

SEQ ID NO: 11230 - DNA, 455 bp, Homo sapiens
  misc_feature 186, 212, 345, 367, 388, 403, 417, 431, 451: n = A,T,C or G
tttgctactggtgggcttgaaagcagttagtttattagcacaatggttgccaatatgcaatcgattagttttcggctcttctttactggaagctacattgtctatttctcctccaagaccaaccactttaagtttagatctcactaaaaacaccacagaaaaactccagcccagttcaccaaaggntatctttacattcaaatgcagctgtncagaaaagaaaacctcaaagactggatgaatggacgatgtaccatagaggagagagagaggagcgtgtgtctgcacatcttcctgcagatcgcagaggcagtggagtttcttcacagtaaaggactgatgcanagggaccttcaagccatccaanatatcctttacaatggatgangtggtcagggttggngacctttgggttangtgactgcaatggncccaggattaggaagaacanacgg

SEQ ID NO: 11231 - DNA, 469 bp, Homo sapiens
tcacataaacacactcaagtatgagtctttcattttctgaaaacaagaacacaggaaaacaagtccttttccctctcccctcagaaatgtgtgcattttcccaccaggctaacagtggctacctctgcaccacatcactgatttcctgtacacatgacaataagttattaaggacagggtttgtcccgggcacaccagcagctgctgaagaaacctgtagctcctgcaggctgagttccagtttgctcacagcctctcggaaggcaaatttgttgcgagtttgagggatgcagtccacatagcctgagcagtagtcaagcagctggtgtccagtgtctaccagctggctgttgggcacaggttccgtgagtgcactggacagtaggtcagcacattccagcagggcctctttgctgattttgtctgctgagattttactcagcggctgtttggtttttctcagagccac

SEQ ID NO: 11232 - DNA, 809 bp, Homo sapiens
cttagcgtttcttcattatgatttattggtccctccctgtccctcccacccgtcctcacccaccccactgcacccctggaggggaagggtcctgtggagacagcgagggggtccccatcaccccagggcatcaggccgatcggccggtgaccttcctgatccaggacacgtaaggcgccacagcggtggccacgggaggcttgaagatgtcagtgcagaccctggagctgaaggacaggactccggccaacacccggcctttgccacacaccaggggcccgcacgagtcacccttgcagggagcctggtccttggagtcggccgccaggcaaaccatgctgggggagaggctgccgttccagaagcggctgttgttacacatgcgggtgtccagcacttggaggtccagctcccgcagcacccgggacaggcgcccgccctggtgggtcagcccccagccggccatgctgcaccgagtccctgctgccaccacctgacgcttactgggcagggccaacggccggatggtccggcttggcttcactttcccgtccagctgaagcagcgcgatgtcgttctccaggcaaggacgggcttgtagcgagggtgctggatggctgccttgatgtagaaagtgagacccgggctgtcccaggtgtggagccccagcaccagcctcagctggccatccgctgggccaggcagtggggcaccgtcacacccattttggtgaccaagacacccccgcacagttgagccatttatctgcatatgcactgtacggctcccattgggattacttcccgccc

SEQ ID NO: 11233 - DNA, 477 bp, Homo sapiens
  misc_feature 277, 386, 428, 433, 449, 461, 468: n = A,T,C or G
gtagcgggtgggccctggcccagcgtcccctgccagcatcctcgtgggctcacagaccccggcctcggagcccgtctggcacccagagtgaccacaagtccagcagggaggcggcgccgccatcgccgtgtccgtgttttctttttcagccccggagagggtcctgacctgggggcttctccaagcctcactgcgccagctccccgcccgctctcttttctcccaagcaaaaccaaatgcgccccttcacctcgcgtgcccgtgcgaggccgggggnttctttcagagcccgcgggtcctctcatacatggcttctgtttctgccgagagatctgttttccaattatgaagccggtcggtttggtcagactcccgacaaccacgtnccaggtaaccggtgggaaaagtgggcagttccgagggcgcanatttngggtggttggcagggnccccagaggttncgggttnaactgggga

SEQ ID NO: 11234 - DNA, 418 bp, Homo sapiens
gacgggctgccaggtttgtcatagcactcatcaaagtccggtcaacgtctgtgcttcgaatataaacctgttcatgtttataggactcattcaagaattttctatatctctttcttatatactctccaagttcataatgctgctccatgcccagctgggtgagttggccaaatccttgtggccatgaggattcctttatggggtcagtgggaaaggtgtcaatgggacttcggtctccatgccgaaacaccaaagtcacaaacttcaactccttggctagtacacttcggtctagccagaaaaaaagcagaaacaagaagccaaggctaaggcttgctgccctggccaggaggaggggtgcagctctcatgttgaggagagctgtttctggcaggagttaggaggaacgtcgacgcgg

SEQ ID NO: 11235 - DNA, 308 bp, Homo sapiens
  misc_feature 118, 167, 202, 246, 264, 278, 289, 302: n = A,T,C or G
tgtcaccaatcctttgcagataatgtatagtgtgtcacaaggacatcgacctgttattaatgaagaaagtttgccatatgatatacctcaccgagcacgtatgatctctctaataganagtggatgggcacaaaatccagatgaaagaccatctttcttaaaatgtntaatagaacttgaaccagttttgagaacatttgangagataacttttcttgaagctgttattcagctaaagaagacaangttacagagtgttttcangtgccattcagctntgttgacaagnagatgatgggatnaatctt

SEQ ID NO: 11236 - DNA, 466 bp, Homo sapiens
  misc_feature 127, 421: n = A,T,C or G
acattgtctaacaccttttattattgctttgtctcctaggagaatggagaccttgaggaggcaggggagtcttccttgttgagaaatctatgcccagcatccagatgtcccgggagcccatgggtcntgggttgctgccctgtacccagagctcctcaagcgctccttggatctggtgacctggaatgggcactggggggcaggaagcatctgagtggctgtgacttggggcaagcctctgcctcattggtcccttggtcaggtgcaggggtgtggaatgatcctagtggggagacagcagaggactgtgtcaaagcccccctgggaatccccgatccagtagcctccttgggtgggttgcagggttgccggaagcttctcttcttcaggtgtcctgatccacccaagtccttgggtctancaggtgctgccaggattgaagctaagacggtggggcacgcggtca

SEQ ID NO: 11237 - DNA, 509 bp, Homo sapiens
tccaccgcggtggcggccgctctagactagtggatcccccgggctgcaggaattcggcacgagtggcagacagcttttcgcttaacgatgccttagctggctctggaaacccaaaccctcaaggatatccgggtgcatgggggaaccagcctggggcagggggctacccaggggctgcttatcctggggcctacccaggacaagctcctccaggggcctacccaggacaggctcctccaggggcctacccaggacaggctcctcctagtgcctaccccggcccaactgcccctggagcttatcctggcccaactgcccctggagcttatcctggctcaactgcccctggagccttcccagggcaacctggggcacctggggcctaccccagtgctcctggaggctatcctgctgctggcccttatggtgtccccgctggaccactgacggtgccctatgacctgcccttgcctggaggagtcatgccccgcatgctgatcacaatcatg

SEQ ID NO: 11238 - DNA, 507 bp, Homo sapiens
tccaccgcggtggcggccgctctagaactagtggatcccccgggctgcaggaattcggcacgagtcgcaatggcattcctaatgcttaccgaacgaaaaattctaggctatatacaactacgcaaaggccccaacgttgtaggcccctacgggctactacaacccttcgctgacgccataaaactcttcaccaaagagcccctaaaacccgccacatctaccatcaccctctacatcaccgccccgaccttagctctcaccatcgctcttctactatgaacccccctccccatacccaaccccctggtcaacctcaacctaggcctcctatttattctagccacctctagcctagccgtttactcaatcctctgatcagggtgagcatcaaactcaaactacgccctgatcggcgcactgcgagcagtagcccaaacaatctcatatgaagtcaccctagccatcattctactatcaacattactaataagtggctcctttaacctc

SEQ ID NO: 11239 - DNA, 444 bp, Homo sapiens
  misc_feature 195: n = A,T,C or G
tccaccgcggtggcggccgctctagactagtggatcccccgggctgcaggaattcggcacgaggactaaaaggactctacccaagaagagctttgaacagatcagtgccaatataactaagtttaacattcagggccttgtcatcattgggggctttgaggcttacacagggggcctggaactgatggagggcangaagcagtttgatgagctctgcatcccatttgtggtcattcctgctacagtctccaacaatgtccctggctcaaacttcagcgttggggctgacacagcactcaatactatctgcacaacctgtgaccgcatcaagcagtcagcagctggcaccaagcgtcgggtgtttatcattgagactatgggtggctactgtggctacctggctaccatggctggactggcagctggggccgatgctgcctacat

SEQ ID NO: 11240 - DNA, 139 bp, Homo sapiens
  misc_feature 122, 137: n = A,T,C or G
aaattctgtgacagatttttggtcaagttgtttccattaaaaagtactgattttgaaaactaataacttaaaactgccacacacaaaaaaaatggtccacaacattctttccttctgaaggntttacgatgcattgntt

SEQ ID NO: 11241 - DNA, 828 bp, Homo sapiens
  misc_feature 8, 9, 10, 13, 17, 28, 39, 41, 57, 59, 60, 67, 86, 102, 641,649, 667, 678, 736, 749, 762, 769, 777, 782, 783, 790, 795,796, 800, 803, 810, 812, 814, 820, 821: n = A,T,C or G
tttgaccnnncgnaaancttgcttgttncttttggccgnancggcctaggctgcganannagacagnaaggtgttgtctccccgtnaaaccctgcttcaggnagccacaacagggcagctggtgactgggatgtctttgaggctcactgttaccagccccagtatcttggctgcactggtgggcctcacagcctcacaccatcatggaggcactcatggtgcccgggcactcctctgtgcaaccctctgagcctcactttcacatcttcaagttacttcctcatctctttcattttccttcttactgaacttgaagaaaacacctctgctctccaagtgcatgcctcggtgcagggctgggcacctttccctccaggtctaggctgagcctgtccctcgccagcacggtcttgtttttgctccttggagccgatcctggggcggcacaggtgctcctgaaaccacctgtcggaggaggactagtgagggactgggcgtggtcatggctgacttcttggcatttgcccgcctgcctttcagtgtgtcctgtgcgcctcccttgggtggggtctccttgcccctgctcccacagggatgttctccagggtgcaggtaggagaactaaacctttcaaagtgtgntcattggnaaaattttggaaaggggnctgggcgcggnggctcatgcctataatcccacactttgggaggctgaggcagggggatacctgagttangagtgaagaacancctgccacatggnaaacccntcttactnaaaannaaaattnctggnngggnggnagggccngnanccactnntgggagg

SEQ ID NO: 11242 - DNA, 483 bp, Homo sapiens
  misc_feature 3, 4, 10: n = A,T,C or G
agnngacagnagggctgccatggcattatttaatgaaataatttttaaaaatgcttttattttactgtaagccattgaagaaaaattttactcaaagtttaacaagtgtttagttcatgatgaggcatttgcagctgtaagcaatcatattactgtgccatcatttagttttatggaaaatgaaaacgtttacttaaggctgttaaaagtttgttttttaatagtgcctcctaagcaatacaggctaccacttacttttgacatcgagggaaaaagagttactcagattcattcaagctttagttatattgatttctacgatgggtttttcttagcatgtcaagtgattcctgttttatagtgaaggcattactttgagtcaatatcaaagtacatgatcccctcaaccttcaactgtgtttcctgctttgtgaggtgccaacaatagcaagaagggataatttaaattccgctttccatagg

SEQ ID NO: 11243 - DNA, 783 bp, Homo sapiens
  misc_feature 1, 8, 13, 722, 742, 751, 766, 774, 778, 779: n = A,T,C or G
nagacagnagggnatttattataatttgtttgactttattatagaattgactttccaagtgttcatgagaattattgagaattcgctacatagtatcatttcagttgtgtccacatgaattatcagtcaccttgtcttaatgaataatggttcactacaaatattggttttggcatttaaagtgatctatatctaaatgcagataggaccagggaccactcttgaacattaatgtccaagcatcttaaaattacacatgaggctttcataatctgacttctgccccactctccatctttagcccttttccctgtgtgccctttctctgtcattgctgagctgctggtagtgccctactcactcatccttctattgtaggcaaatactttcattctttcaggcctcgctcccgctcttgctgctgccgggcatgctgtcaccctttcctgccctctaccccttttaatctggccagcctcaatatttaagtctctgcttgggcatgtgttctgaaaagccatccctgagatgctttattttcattctttttagaccctaatgcctagcatgtatgtagcaggactcaatacaaattttctgagtaaaacaaagactgttttacaaagatgatgtgcaagactctccctgcagtcttggagcagagggacagacatatggagaaatatgtcagctaaccggtaagagccgaaaaatagtaaatnctaagcagcctcaggagganaactggttnttgggaagactgcanatcagganactnntaac

SEQ ID NO: 11244 - DNA, 718 bp, Homo sapiens
  misc_feature 1, 9, 542, 618, 665, 667, 694: n = A,T,C or G
nacgacagnagggggaagccaagtctatatttgatgatgatatggatgacatcttctccactggtatccaggctaagacaaccaaaccaaaaagccgatctgcacaggccgcacctgaaccaagatttgaacacaaggtgtccaacatctttgctgatcccctgaatgcctttggaggccagtagagcacacagggtatccacatgttaccctgcagctacattgttgagttagtgatgatattgtatatgctcatggtcttaactggattacaaaaagcaaatactagaacagctagctcatcttttacccaatgtacttagtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatctcagagatagcaaatgccacctgaccagaagtctttgtntatggatgggaaccctaacttaaggcttgggcaggggaaagagaagaaatgagagattatacttcatgagtcttancatatggaacaggtttactgattctgaggtgcctttgctgtctccangnaagttggcaactggggccccccctgtntatttgtaataaatttattggacc

SEQ ID NO: 11245 - DNA, 683 bp, Homo sapiens
  misc_feature 1, 8, 10, 15, 30, 46, 641, 676, 682: n = A,T,C or G
nagacagnanggggnaagtctgttccaggnacgggctctttcaggnagcagctaaagtcaggggccatgtccaccatgtgatagaaagacaagatggtcctgaaattctccgtgtccattctttggattcagttggcatgggtgagcacccagctgctggagcagagccctcagcttcctctgcattgcccctcttctccctctccaaacagagggaactctcctacccccaaggaggtgaaagctgctaccacctctgtgcccccccggcaatgccaccaactggatcctacccgaatttatgattaagattgctgaagagctgccaaacactgctgccaccccctctgttcccttattgctgcttgtcactgcctgacattcacggcagaggcaaggctgctgcagcctcccctggctgtgcacattccctcctgctccccagagactgcctccgccatcccacagatgatggatcttcagtgggttctcttgggctctaggtcctgcagaatgttgtgaggggtttatttttttttaatagtgttcataaagaaatacatagtattcttcttctcaagacgtggggggaaattatctcattatcgaggccctgctatgctgggatctgggcgtgtggntgtcctgctgccgatgccttattaaatgatttggngaaaana

SEQ ID NO: 11246 - DNA, 463 bp, Homo sapiens
  misc_feature 18, 31, 32, 33, 44, 55, 59, 66, 79, 80, 89, 91, 96, 105,106, 135, 142, 147, 154, 168, 169, 172, 174, 178, 187, 194,195, 202, 207, 208, 229, 238, 247, 257, 263, 288, 301, 329,333, 350, 354, 388, 398, 399, 400, 413, 415, 416, 422: n = A,T,C or G
  misc_feature 429, 430, 437, 442, 453, 459: n = A,T,C or G
ataagggtcctggctgcnaaaacacgactgnnnggtacgggctnccagaatgacnacanaagggtncggctgcgacaannccacacaangnttcgngctgggagnnaacgactaaatacctgcgccctgaagtanggacganggagngtttctnctggggctcaacgnnttntnctcntcaaacaangatcatnnatgttgnctacnntgcatcttataccgagctggnttcctaccntgaccctgntgaagaattncatcgntgctcatcaacagcacaccgtaccnacagtggtacgantcctactatgcactgcccctgggccgcntgangggagcccagctgactnctgnggatgaagagattttaaacaaaaaacgatctctnaaaattcagnnncaaatatgatgangnnaaaaanactgccnnaatcatncagtnttctggatgancatttncagc

SEQ ID NO: 11247 - DNA, 513 bp, Homo sapiens
agaactatgcagtatttaagcctcaacaacccaaatctacaaactttaacaatgcaagtcttactctaatttttaagtatttttgtaggtacttacatgggttataaatcctctctctggacatcaatgtagagtccatctttcaagcactttaatttttttagctgccaaagggtatgaattacattattgtatgctaatttccctgaaatcaatgccttctatgttcaccacagggatacaagcctgttatgtttgatgggaaagaccactacaatctaatggtgatctaaaataacttttttgggctgggtgcagtggctcatgcctataatcttagcactttgggaggccaaggtaggaggattgcttgaagctaggagtttgagaccagcctgggcaacagggtaaggtcctgtctctacaagatcaaaaacttagccgggtatggtggtgcatgtgtgcctgtagtccaagctacttgaaggctgagacaggaggatcggttgagcc

SEQ ID NO: 11248 - DNA, 555 bp, Homo sapiens
  misc_feature 327, 328, 329, 330, 331, 332, 333, 334, 335, 336, 337, 424: n = A,T,C or G
tgttacctgccgacagcataaagcgaggcaaggtccagccgttccgcccggcatacaagcttatggagcagccccctttgaagatctccaggtggacttcacagggatgtcaaagtgtagaggtgatcgagtgtggatcaagaactggaacgtagcctctttgtgtccactgtggaaaggaccccagactgtcgttctgagcactcccaccgctgtgaaggtagaaggaatcccagcctggatccaccacagccatgtaaaacctgcagcgcctgaaacctgggaggcaagaccaagcccagacaacccctgcagagtgaccctgannnnnnnnnnnagccctgctccagtcacacccggaagctgactggtccacgcacggccgaagcctgaggaagctcatcatgagattcatttttcttanattttggacttatacagtaagggcttcaactgatcttactcaaactggggactgttcccagtgtactcatcaggtcaccgaagtaggacagcaaattaaaacaatcttactgttctatagttattatgaat

SEQ ID NO: 11249 - DNA, 788 bp, Homo sapiens
  misc_feature 1, 9, 722, 772, 781: n = A,T,C or G
nggggaggnacatgaatagtcgccaggcttggcggctcttgctctcccaggcagaggagatcgttgggtttcaaggccccgcgggcatttctcgccggccctgcggagagagttcttcactaccacaaccaaggagggatatgataggcggccagtggatataactcctttagaacaaaggaaattaacttttgatacccatgcattggttcaggacttggaaactcatggatttgacaaaacacaagcagaaacaattgtatcagcgttaactgctttatcaaatgtcagcctggatactatctataaagagatggtcactcaagctcaacaggaaataacagtacaacagctaatggctcatttggatgctatcaggaaagacatggtcatcctagagaaaagtgaatttgcaaatctgagagcagagaatgagaaaatgaaaattgaattagaccaagttaagcaacaactaatgcatgaaaccagtcgaatcagagcagataataaactggatatcaacttagaaaggagcagagtaacagatatgtttacagatcaagaaaagcaacttatggaaacaactacagaatttacaaaaaaggatactcaaaccaaaagtattatttcagagaccagtaataaaattgacgctgaaatgcttccttaaaacactgatggaatctacaaacttgagacattcgtatcttgcgcttcagtgntacttgcctggcatacattgggatttatagatctggagagataagctctnctgctgggntgtggct

SEQ ID NO: 11250 - DNA, 714 bp, Homo sapiens
  misc_feature 5, 7, 11, 18, 37, 47, 611, 656, 674: n = A,T,C or G
acagnangggnaaccagnagcccagtcacaggcgagnagccctgggnatgcaccggccagagccatgctgctgctgctcacgcttgccctcctggggggccccacctgggcagggaagatgtatggccctggaggaggcaagtatttcagcaccactgaagactacgaccatgaaatcacagggctgcgggtgtctgtaggtcttctcctggtgaaaagtgtccaggtgaaacttggagactcctgggacgtgaaactgggagccttaggtgggaatacccaggaagtcaccctgcagccaggcgaatacatcacaaaagtctttgtcgccttccaagctttcctccggggtatgttcatgtacaccagcaaggaccgctatttctattttgggaagcttgatggccagatctcctctgcctaccccagccaagaggggcaggtgctggtgggcatctatggccagtatcaactccttggcatcaagagcattggctttgaatggaattatccactagaggagccgaccactgagccaccagttaatctcacatactcagcaaactcacccgtgggtcgctagggtggggtatggggccatccgagctgangccatctgtgtggtggtggctgatggtactggagtaactgagtcnggacgctgaatctgaatncaccaataaataaagcttctgcagaatcagtacaaaaaag

SEQ ID NO: 11251 - DNA, 589 bp, Homo sapiens
  misc_feature 48, 545, 559: n = A,T,C or G
acaagcccgtgtccccgctgctgctggcctcaggatggcccgcgactngcccgacgcccgtggatctggcacaatgacaacaagagcttcctggtgtgggtgaacgaggaggatcacctccgggtcatctccatggagaaggggggcaacatgaaggaggttttccgccgcttctgcgtagggctgcagaagattgaggagatctttaagaaagctggccaccccttcatgtggaaccagcacctgggctacgtgctcacctgcccatccaacctgggcactgggctgcgtggaggcgtgcatgtgaagctggcgcacctgagcaagcaccccaagttcgaggagatcctcacccgcctgcgtctgcagaagaggggtacaggtggcgtggacacagctgccgtgggtcagtatttgacgtgtccaacgctgatcggctgggctcgtccgaagtagaacaggtgcagctggtggtggatggtgtgaagctcatggtggaaatggagaagaagttgagaaaagccagtccatcgaacgacatgatnccgcccagaagtangcgcctgccacctgcaacgatgttgaaacc

SEQ ID NO: 11252 - DNA, 617 bp, Homo sapiens
ctctctctgtcacccagctggagtgcagtggcatgatcttggttcactgcaacctcctgcctcagcctcccaagtagccaggattacaggtgtaggccacgatgactgggtaatttttgtatttttcatagagacggggtttccccatgttggccaggctggcctcaaactcctgaccagaaaggatccacccacctcagcctcccaaagtgctaggattacaggcatgagccactgcacctggctataactttacaatttaaaaaacactttctttcctgtctttcccctcatttgatcttcaaaatgaacttaagacttcttcaaagtgactcagccaaaaagtagtaaaacctaaacttgaactcaagtgtcttgcgacctgagaaccgtttcccttctccacctgggcacattactctccctctacggccaacaactacatgcttactggctcctacctccccactcgggcttatttatcttttctcaagttcttcaagatccctgctatccattcctaaaaccttgcttaaatctcaccatttctacaaagggctctttaattagtctagcttatctgtcacttcagacagcccaggacttaacatatgtag

SEQ ID NO: 11253 - DNA, 586 bp, Homo sapiens
ctgatgtccgattctgtacagagatagctgcttacatcctccgcctcttctttgggttcacggcgggcgatgatggcctcggacttcactcttttcagttcctcttccagctccttgatacggttttccagcttgactttggcctgcttagcacctccaactcgcccctcagcacctcctgctccccggacagctggtcgaccttggcaatcaggtcattcttcaccacattcaaggcgtttttggtttccagaagctgtgagttttccagtagcagattccccacttctttgcccattcctgagaactcccctaggaggtcggccccttcgtccacatccccgatgacctcagaccctgccgtcgacagctcatggtacagggagtcggtgttgatgccgaaagctttgttcacgatgccctgggttgggctgcttcctgtgcggtccaggcgggtctctggacacatgtccagctctggcgtggagtcaataatgtcttgaacatcagaccactcgtcactgctgcacatgcctatactgacgttgcgcatctcctgggtgactgtacttcatgttgcggctgt

SEQ ID NO: 11254 - DNA, 454 bp, Homo sapiens
taaattgagcagaaattcccaaggccaacctagctctcagggaccaacctgcagaactcaagattgagcgaaatgtttaggccagttgagttttgcaaaatgagtggtaagggaaaacagatctagcctgttatttaaaaccagggttcaaaagccctattgggagaggtagtattgtcctagcatttaaattctcatgaaatgtgcttggtctgtgatctcttggtcagatatctgccttccaggcgatcctttgaggttgtgtaattcagctggccctggctcctggtccctgttactgagctgggcagtcgaaccgaagggcagatgagctcaagatcatgccttgggaagcatggtgctctaggggtgcctttttattcctttcattgtattatagactgtttccaagtttatggttagaaatggtaaagtgggtctggtgttttgaggt

SEQ ID NO: 11255 - DNA, 237 bp, Homo sapiens
ctttgggaactagggggctgctggtgggaaatgggagccagggcagatgtatgcattcctttgtgtccctgtaaatgtgggactacaagaagaagagctgcctgagtggtactttctcttcctggtaatcctctggcccagcctcatggcagaatagaggtatttttaggctatttttgtaatatggcttctggtcaaaatccctgtgtagctgaattcccaagccctgcattgtac

SEQ ID NO: 11256 - DNA, 286 bp, Homo sapiens
tatttacacgtttgcccataaatagaaatgtgggctatttactctgaccaagggagcacacaaagagatgaaagatgacgtcagtgttctattactggagtaacatattggatttatgattgctcattgcaacttctttagaaatgatcaagtcagatattagagtgtcagcataaaccactgatgatggttcatgaagcatagatcatgattaatccaattatgttcattagaaaaagttctataatataacctaagagtattttctagtattgcccaatggaac

SEQ ID NO: 11257 - DNA, 597 bp, Homo sapiens
tcggcacgaggctgctttgaaaagtcacctctatcatgtttctagtagcgcttagtgaatatgatcaagttctcgtggagtcagacaatgagaaccgaatggaggaaagcaaggctctctttagaacaattatcacatacccctggttccagaactcctcggttattctgttcttaaacaagaaagatcttctagaggagaaaatcatgtattcccatctagtcgactacttcccagaatatgatggaccccagagagatgcccaggcagcacgagaattcattctgaagatgttcgtggacctgaacccagacagtgacaaaattatctactcccacttcacgtgcgccacagacaccgagaatatccgctttgtctttgctgccgtcaaggacaccatcctccagttgaacctgaaggagtacaatctggtctaattgtgcctcctagacacccgccctgcccttccctggtgggctattgaagatacacaagagggactgtatttctgtggaaaacaatttgcataatactaatttattgccgtcctggactctgtgtgagcgtgtccacagagtttgtagtaaatattatgat

SEQ ID NO: 11258 - DNA, 386 bp, Homo sapiens
cggcacgaggagctaccatttttaacactccttgttatctactgcaacataaataacagtcttaattgcacttatacccatgtcctgtggctctacaaatctgttctttgctgttgtgtctgctggacgcttgaactgatgtttgtgtatgaaatcatgttctgaccctttgtctacaaaggagccttctggaacactgataacaaacatctctttgccattcctgaccagttctctctaccacattttcttcaactccatacttctgcctgtctgctctaaagaaatttcatggagccttcctactactaattcaagacagtctcctcaaaaactggttgactactcttctaatgaccctaacatatgtagcatatactataatt

SEQ ID NO: 11259 - DNA, 628 bp, Homo sapiens
ctacttgttctttttgcaggatcccatcgattcgaattcggcacgaggtttgtttccccgagatgtgaacttgctgaaggaaaacagtgtaaagaggaaggccatacagagaactgtcagctcttcaggatgtgaaggcaagaggaatgaagacaaggaagcagtgagcatgttggttaactgccctgcctactacagtgtgtctgctcccaaggctgagctactgaacaaaatcaaagagatgccagcagaagtgaatgaggaagaggaacaggcagatgtcaatgaaaagaaggctgagctcattggaagtctcacccacaagctggagaccctccaggaggcgaaggggagcctgctcacggacatcaagctcaacaacgccctgggagaagaggtggaggctctgatcagcgagctctgcaagcccaatgagtttgacaagtataggatgttcataggggatttggacaaggtggtcaacctgctgctctccctctcggggcgtctagcccgtgttgagaatgtccttagcggccttggtgaagatgccagtaatgaagaaaggagctctctttacgagaaaaggaagatcctggctggtcagcatgaggatgcccgggagctg

SEQ ID NO: 11260 - DNA, 783 bp, Homo sapiens
  misc_feature 2, 3, 7, 8, 10, 11, 12, 15, 17, 26, 29, 33, 37, 43, 44, 46,53, 60, 141, 217, 680, 736: n = A,T,C or G
gnntttnnannnccngntttctaatnctnttcnaatnctttgnnancgttctntatgcangacccatcgattcgggaatctcctagaaaagttgtgattttcgagccatatccttctgtggtagatcctaatgatcctcanatgttggccttcaaccccaggaaaaagaactatgatcgagtaatgaaagcactggatagcataacttctatcagcnaaatgacacaagcaccatatctggaaatcaagaagcaaatggataaacaggacccccttgctcatcccttactgcaatgggttatatcaagtaatagatcacatattgtgaaactgccagttaacaggcaattgaagtttatgcatactccacatcagttccttcttctcagcagtccaccagccaaagaatccaattttagagctgctaaaaaactctttggaagcacctttgcatttcatggctcacacattgaaaactggcactccatcctgaggaatggtctggttgttgcttctaatacacgattgcagctccatggtgcaatgtatggaagtggaatctatcttagtccaatgtcaagcatatcatttggtactcagggatgaacaagaaacagaaggtgtcagccaaggacgagccagcttcaagcagtaaaagcagcaaatacatcacagtcacnggaaaaaaggacagcaatcccaattcctgccaaagccgtaacttaaaatgcatagnccttatgtgaaagggatcaccttcatctggacctgcacaaacatggc

SEQ ID NO: 11261 - DNA, 501 bp, Homo sapiens
caagctacttgttctttttgcaggatcccatcgattcgaattcggcacgagacccccttcatggacagatcccccacagcctggggcagaagaggcgtcgagggcgccagaagtggcggcagcagcagccgcagcagccaaagagaggcaagagaaagagaaagcgggcggtggaggggtcccggaagagctggtccccgtggttgagctggtccccgtggttgaattggaagaggccatagccccaggctcagaggcccagggcgctgggtctggtggggacgcgggggtgcccccaatggtgcagctgcagcagtcaccactagggggtgatggagaggaagggggccaccccagggccattaacaaccagtactccttcgtgtgagccaaccccacccgctccaccctttttaaaccccccagccctgctcgtgagattgggctgggtagggacagaggaggccgaaatccctcccccatgcttcctgacccttgttg

SEQ ID NO: 11262 - DNA, 548 bp, Homo sapiens
  misc_feature 432: n = A,T,C or G
tacgaatttaatacgactcactatagggaatttggccctcgaggccaagaattcggcacgaggtcaacagtgtatacttctggagccttctactgataaacagaggccccagaagacgatttgacttacctgagctcccagctgggacttaaacccaggtgtgtctgagtcacaactcttcggggatgccgtggtgagctggggctgagctcctgtattcccactcccccaccccacccccactcctgccatatcagggctggtctctgtggactcagcccagggctgcctcctctttgtcaccccaaagtggggcagccagggacagccagggtgtgttcagaatgggttcttcctgcagggcaggaagggcagattgttaaaggggctgcggcccaaaccaccctggtccctcctccggcagtgactcanacccacactgtgccgtgcagctgtgtgccctgcacacccgcttgacggcgcactgctcacttctggggggccctttcagaggcacttttaaagcaaataaaacatttattgttcag

SEQ ID NO: 11263 - DNA, 206 bp, Homo sapiens
cgactcactatagggcgattgggtaccgggccccccctcgaggtcgacggtatcgataagcttgatatcgaattcctgcagcccgggggatccactagttctagagcggccgccaccgcggtggagctccagcttttgttccctttagtgagggttaatttcgagcttggcgtaatcatggtcatagctgtttcctgtgtgaaatt

SEQ ID NO: 11264 - DNA, 514 bp, Homo sapiens
gctccaccgcggtggcggccgctctagaactagtggatcccccgggctgcaggattcggcacgagaactggtctcaagtcagtgtacaggtaagccctggctgcctccacccactcccagggagaccaaaagccttcatacatctcaagttgggggacaaaaaagggggaagggggggcacgaaggctcatcattcaaaataaaacaaaataaaaaagtattaaggcgaagattaaaaaaattttgcattacataatttacacgaaagcaatgctatcacctcccctgtgtggacttgggagaggactgggccattctccttagagagaagtggggtggcttttaggatggcaagggacttcctgtaacaatgcatctcatatttggaatgactattaaaaaaacaacaatgtgcaatcaaagtcctcggccacattgtgaactttgggggatgctcgctccaaccgactgctgtcaccttcaccgttccagtttttaaatcctgagtcaagcc

SEQ ID NO: 11265 - DNA, 368 bp, Homo sapiens
  misc_feature 208: n = A,T,C or G
taatacgactcactatagggaatttggccctcgaggccaaaaattcggcacgaggggtgggggggtgccgttggtgggagagacaaaaagagggagagtgtgctttttgtacagtaataaaaaataagtattgggaagcaggcttttttcccttcagggcctctgctttcctcccgtccagatccttgcagggagcttggaaccttantgcacctacttcagttcagaacacttagcaccccactgactccactgacaattgactaaaagatgcaggtgctcgtatctcgacattcattcccacccccctcttatttaaatagctaccaaagtacttcttttttaataaaaaaataaagatttttatt

SEQ ID NO: 11266 - DNA, 62 bp, Homo sapiens
atttaatacgactcactatagggaatttggccctcgaggccaagaattcggcacgaggcgtg

SEQ ID NO: 11267 - DNA, 612 bp, Homo sapiens
gaacaaaagctggagctccaccgcggtggcggccgctctagaactagtggatcccccgggctgcaggaattcggcacgagagttttaagtttctctaggatagcttatattttaccagcaaatgaaagctttggacctctgcagatatcacttggaagaacagtcaaagacatcttcaagttcatggtcatattcattatggtgtttgtggcctttatgattggaatgttcaatctctactcctactacattggtgcaaaacaaaatgaagccttcacaacagttgaagagagttttaagacactgttctgggctatatttggactttctgaagtgaaatcagtggtcatcaactataaccacaaattcattgaaaacattggttacgttctttatggagtctataatgttacgatggtcattgttttgctaaatatgttaattgccatgatcaacagttcattccaggaaattgaggatgacgctgatgtggagtggaaatttgcaagggccaaactctggttttcctactttgaggagggcagaacacttcctgtacccttcaatctggtgccgagtccaaagtccctgttttatctcttactgaagctt

SEQ ID NO: 11268 - DNA, 219 bp, Homo sapiens
ggttgctcctaagcacctggttggtagaagctttcatgtattgtaacgctaaacctgtaatttttcagggctggggagtgggaagggggttttcatttaaggacgtctgtgctttaagaatattttaggtttgtggtccagctgacattttctttattttaaagttggagaggctgggcgcagtcgctcacgtctgtaatcccagcactttgggaggct

SEQ ID NO: 11269 - DNA, 62 bp, Homo sapiens
ctatgacgtcgcatgcacgcgtaagcttgggcccctcgagggatcctctagagcggccgccc

SEQ ID NO: 11270 - DNA, 537 bp, Homo sapiens
gtctacgtcctggccaacgagccatccgtggccctgtaccggctgcaggagcatgtgcgtcgctccctccccgagctggcccagcacaaggcagacatgcagcgttgggaggagcagagccagggagccatctacactgtggagtacgcctgcagcgccgtgaagaacctggtggacagcagcgtctacttccgcagcgtggagggtctgctcaaacaggccatcagcatccgggaccatatgaatgccagtgcccagggccacaggtagctcctgggaccgcccgcccccactgccactcccagctgcaaggaccgtctctcagctgcgctgggaaccgctgcttctcgcttattagaaaactgtctctttccttttgtcctggtgtctggtgatctcctcttgtcctgtggcatctataacctgagttcagtcacttaataccgaggtcctgcgctctgctgtgtgcctggccctgggctgggcactggggacatagcagtgaccgagacagacaggctcacaaggagacatacg

SEQ ID NO: 11271 - DNA, 730 bp, Homo sapiens
  misc_feature 609, 659, 660: n = A,T,C or G
gcaagtcacgggagtttatttatttaattttttccccagatggagactctgtcgcccaggcggcattttcccccatcagaaagccggggctcctgtacctcaaaatagggcacctgtaagtcagtcagtgaagtctctgctctaactggccaccggggccattgtcttctgacacagccttgccaggaggcctgccatctgcaaaagagagttcactccttccgctattttcatgtgagtgtatccaatttccttgataaactccagtttcaggtattctgccatttggaaagttttacacactcgaaagatgttgccaatgatatcttctggtgagtagcccagatgccacaagtgagcaagaatcttgtaggcttcgtcaatgttggcattcacacagtgctggatcatctcctttaccagcagtgggtggggctcgtcacagaccttgaacacgttctcactgttaatgaagccaaatcctgagaaggtggactgcaggttgttcagcgcctgcctcatgtctcccttggccgtgaagatgatggcttctaggccgtcatcagtgtagggtaccctctccttctcgataacattcatcagcctggntgagatcctggcgtcggtcagctttgtgtacccggagactgcacagcggnnactgatgggctcgatgatctatcccgagcattacaagcaagggcgaagcgagtgttttagagtgaatttc

SEQ ID NO: 11272 - DNA, 701 bp, Homo sapiens
  misc_feature 645: n = A,T,C or G
gcggccgctccctccgcctattccctccttgctcgagatggatctgcccgtgggccccggcgcggcgggggccagcaacgtcccggccttcctgaccaagctgtggaccctcgtgagcgacccggacaccgacgcgctcatctgctggagcccgagcgggaacagcttccacgtgttcgaccagggccagtttgccaaggaggtgctgcccaagtacttcaagcacaacaacatggccagcttcgtgcggcagctcaacatgtatggcttccggaaagtggtccacatcgagcagggcggcctggtcaagccagagagagacgacacggagttccagcacccatgcttcctgcgtggccaggagcagctccttgagaacatcaagaggaaagtgaccagtgtgtccaccctgaagagtgaagacataaagatccgccaggacagcgtcaccaagctgctgacggacgtgcagctgatgaaggggaagcaggagtgcatggactccaagctcctggccatgaagcatgagaatgaggctctgtggcgggaggtggccagccttcggcagaagcatgcccagcaacagaaagtcgtcaacaagctcatttcagttctgatctcactggtgcagtcaaaaccggatcnctgggggtgaagagaagatccccctgatgctgaacgacagtggctcagcacattcc

SEQ ID NO: 11273 - DNA, 446 bp, Homo sapiens
  misc_feature 150: n = A,T,C or G
gggattccataaaatgacagttgtgtcctagccacatcagacagctatctaagctctggactacccctttgtgcagctgaatcactgcagggttgaccatgcctggtgccacagccatggtttccatttctagatgaaaggatggcctangacataggtctcaaagactcttggatcagaatcaggagattagggaaaacaggatggatacctgagcactaacagcagtagacgtagacctctgtcctttaccatctgaggtcttctggattctttgtggggttaattttgatttgatgtcatctgtttgcccttcatcttgcttgcaagtgtgcatggttcaatccctcatatccaggaaatgaattttgcaattgggccagatgctaatttgcacgttgattcaccttctttgcctttaagccttttttttctttttttttttt

SEQ ID NO: 11274 - DNA, 746 bp, Homo sapiens
  misc_feature 1, 643, 679, 698, 709, 710, 719, 725, 730: n = A,T,C or G
nagacagagggatgaccgaatcagagccttggtggccactgactctcgtgcttattgcagatgctgtggttggcctcacaagcaacgccttatgctgatgtgcagaggtgccagctgccatttgccaaactctgcatttcatttcatctaaggcttaacccctcttccttcctggtgtacctgtgtctcctcggaaggaagtcatagtttagatgaaaccattttttgtacaatgtaaagatcatctgagcaagatgagcattttgtaaaaatgaaaatgtgactcacataaaatcaggaacttgacacagtgttgcattaataactttagggtgcagacatgctgtgtgaatctcacaatgcgtcgtagatgtcgcgtgttggaagggagcaggaggaaggactgatactggcaaatcagtagagtgaggtgatccttagcaacgtgccaggacacttcctgtgtgcctgcagttgtcagggaccatttgggatcccgaatctcattctctaaaactgctttcttgaaacatgttacttccttagtataatcaatgtatactcccttactggcctgaaacgttgtatagctacttattcagatactgaagaccaacggactgaaaaagaacaacattagctntttatgctgcagaccaggacacacattcgccatctncacctataccttcgattgngctttcactcnnccataattntccaanacctntatacctttttcccac

SEQ ID NO: 11275 - DNA, 608 bp, Homo sapiens
  misc_feature 147: n = A,T,C or G
acagaggggtctggtttgatgccactattggctatctgtccatcacagccaactacacagaccagtgggagagatggtggaagaacccagagcaagtggacctgtatcagttcatggccaaagacaatgttcctttccatagcttantctttccttgctcagccctaggagctgaggataactataccttggtcagccacctcattgctacagagtacctgaactatgaggatgggaaattctctaagagccgcggtgtgggagtgtttggggacatggcccaggacacggggatccctgccgacatctggcgcttctatctgctgtacattcggcctgagggcctggacagtgctttctcctggacggacctgctgctgaagaataattctgagctgcttaacaacctgggcaacttcatcaacagagctgggatgtttgtgtctaagttctttgggggctatgtgcccgagatggtgctcacccctgatgatcagcgcctgctggcccatgtcaccctggagctccagcactatcaccagctacttgagaaggttcggatccgggatgccttgcgcagtatcctcaccatatctcgacatggcaac

SEQ ID NO: 11276 - DNA, 608 bp, Homo sapiens
  misc_feature 83, 396, 532: n = A,T,C or G
acagaagggatatcagaacatgactgtggatattctctgcaatgactgtaatggacgatccactgttcagtttcatatattangcatgaaatgtaagatttgtgaatcctataatactgctcaagctggaggacgtagaatttcactggatcagcaatgacgagcctacacagtactggagaacttggcattttctgatatagaaaaaggctttccttggtatcgtgttatcatgtgtcgtcatctatgcattagagttgatgtgttttgtactagtgtcacagcataaaatcatattacaagtacgtaaggattcagggtctcttgatagacttatcatagctctatattgaatgaaagccactgtgcttgtgttttgattggaaattcctttantgtcagttttttggaagccaatgatgtttgccactgatacattcatagaagtgtattatattttcatgaagctttgctttaagtgacactacgcgtgcagttcatttctagttcttgatagaactgcacttaattntcagtagtagtcttgactttttaagggctgtgttatattaagttctcccttactgttaaaacctaattaaatatgc

SEQ ID NO: 11277 - DNA, 752 bp, Homo sapiens
  misc_feature 475, 571, 611, 652, 658, 673, 675, 687, 711, 716, 724, 727,732, 735, 743, 750: n = A,T,C or G
gggattcaatttctcagtttcaatccagaatgatcaggtaaatcaactgttttctttttatacttcgttaaaaggaaagtggggaggggggtggtaatttttacaggtttaatgtagttaaatgaatgtacctaaaggttgaagatttttgtttagttgcagaaaatagagtttaacgtctgtgtttaagataaatttaatgtctaaatgtattttatttgctgtataacactgaaagcactcattagagaaatgttgagactgaattttttaatatgctgatctttattttctaactttctgtgctgattaaattttattatctgtattcatcagagcgtaggccatacaaatgaatttaaagacatttttctttgacatcctagacaaaaatagaaaagagagtcattaaaaaaaatttttaggttgtgtgtggtggctcacacctgtaatcccagcgctttgggaggccaangcgagaggactgcttgagcccaggagtttgagaccagcctgggcaaaatggtgaaaccctgtctctacaaaaaatgcaaaaatagccaggtgtggnggcgtgtcacccgtggtcccagctccttggtggatgaggnggaagatcgcttgagcctgggagatgaactccgtgagtgcncctgcnctcaacctggggaanancaaaccccgctnagtaaaaaaaaacaaccaaaaagnttaanaaatggcnttnttccnggnaaaaatgntttttgngg

SEQ ID NO: 11278 - DNA, 64 bp, Homo sapiens
tccaccgcggtggcggccgctctagactagtggatcccccgggctgcaggaattcggcacgagg

SEQ ID NO: 11279 - DNA, 541 bp, Homo sapiens
ttttatgtttaacaacaaaaaaaactttattgaattacaaattttaaaatggatcacttaaaagtgagattattttattctgaaacattatttcaaaaatgtactttgtttttgaaataaaacaaaatcttcaactatgaactgacaaaatagaggtgagttggtaccagtgggccaattcttaacacggacatttaaaaatgctgctttctgtattacaacaaaatgatatgcaataagaaattggaaaaagggagcaaaggagagtgcaaagcatgtactgaggtctttctacgggtgcctgacagaatgcagattcagcataaaatgtagactttgcaacagtggcctttaaagtatgctagagcaagtgtaccctagggaacctatgtcaaaacaatttttgtcttactccaaacagaaaaaatggtacacactttaacaaaagcaaaacttaattgtaagatctgtactgtaaagctacttgctatagcccatatattcagtttgttcaacaatctcactcatgacagaaaaagtc

SEQ ID NO: 11280 - DNA, 463 bp, Homo sapiens; identical to SEQ ID NO: 3656

SEQ ID NO: 11281 - DNA, 826 bp, Homo sapiens; identical to SEQ ID NO: 3628
  misc_feature 26, 27: n = A,T,C or G

SEQ ID NO: 11282 - DNA, 818 bp, Homo sapiens
  misc_feature 514: n = A,T,C or G
ggtcatcttcagagtcagatactaagagaactgagagaactgtttcttgagaaacaaactggggtatcttcaacatgaaatgatttaggagcatagcctgatgcttgaggtttacttggttctccctgtgagtcagggggctcagtctctttgataggttcattttctttattgttgttttcttggtcaatgtcactgagagaactcagagaggaattatgagaaaagcaaactggagtattttcaatagcaaaattctgtaacttttcatcagttgctgcccctctgtctggtatgtctttggatgactggggaaaagtggattgtttctgaagtatgggtttaggctgacctcgatttattggctgctttgcaatagcttgtgtcttattagctgattgttggttggaggttagttctgtgtggctggtaactttagcctctgattccttatttccttttgcctttcttaattcagccttttccctggaaaggtcaacatcatcatcatcanaatctagagaactcaaagaatcatttcgtgaaaaacagtaaggagtttcttcaataggcgtgtaatgatgaggtgaatcaaaagcaaaactcctcctgactcatcctcaataattggggacctatacatggaagccctgggaattatttccacaatcccgttccttgaaaccctgtgtgggggagaaaacccccccggcattgaaattaatttttgggagccgcacttttttcctaccacgtggcccaatattccgatattgtgggggtaaaggttctaccggggggaagtgggtttccttttc

SEQ ID NO: 11283 - DNA, 409 bp, Homo sapiens
tccaccgcggtggcggccgctctagaactagtggatcccccgggctgcaggaattcggcacgagggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatggagtgtacaccttaaacaatgagaagcagtggataaataaggctgttggagataaacttcctgaatgtgaagcagtatgtgggaagcccaagaatccggcaaacccagtgcagcggatcctgggtggacacctggatgc

SEQ ID NO: 11284 - DNA, 440 bp, Homo sapiens
ttaatggcagctaaagatatacagattactgttaaattgcagtccttttttttttaaagatattttcttgaattatttagaacatggtaagcctggtattttttaatcaaacaaaatatttatgaaatgggttttctcttaattctggattcatcatggctttctaataccaattgtaatatttacaatattcaccaaaacttagaattttgcaaatgctggaattctgccagtgtttctttgctaagccttgcatgcaaaatttgaaattttaacattggcacccaaaacctacatggaatgtatgtctggagtatttcaaactttacattgaaacataatttccttggaaaacaaaccataagcctgaggaggtttttatcaactggaatgctttatattagtttgtttttcactgtacattcctcattttacattca

SEQ ID NO: 11285 - DNA, 410 bp, Homo sapiens
  misc_feature 310: n = A,T,C or G
cagggcacgctgcacccgaaaactccggaactgggtggtggagcaagtggagagtgggcagtttcccggagtgtgctgggatgatacagctaagaccatgttccggattccctggaaacatgcaggcaagcaggacttccgggaggaccaggatgctgccttcttcaaggcctgggcaatatttaagggaaagtataaggagggggacacaggaggtccagctgtctggaagactcgcctgcgctgtgcactcaacaagagttctgaatttaaggaggttcctgagaggggccgcatggatgttgctganccctacaaggtgtatcagttgctgccaccaggaatcgtctctggccagccagggactcagaaagtaccatcaaagcgacagcacagttctgtgtcctctg

SEQ ID NO: 11286 - DNA, 532 bp, Homo sapiens
ctatttaggtgacactataggaacagtttgtacaaaaaacaggctggtaccggtccggaattcccgggatatcgtcgacccacgcgtccgtgggaggtcatgagctatggagagcgaccctactgggacatgagcaaccaggatgtcatcaatgccgtggagcaggattaccggctgccaccacccatggactgtcccacagcactgcaccagctcatgctggactgctgggtgcgggaccggaacctcaggcccaaattctcccagattgtcaataccctggacaagctcatccgcaatgctgccagcctcaaggtcattgccagcgctcagtctggcatgtcacagcccctcctggaccgcacggtcccagattacacaaccttcacgacagttggtgattggctggatgccatcaagatggggcggtacaaggagagcttcgtcagtgcggggtttgcatcttttgacctggtggcccagatgacggcagaagacctgctccgtattggggtcaccctggccggccacc

SEQ ID NO: 11287 - DNA, 496 bp, Homo sapiens
ctatttaggtgacactataggaacagtttgtacaaaaaagcaggctggtaccggtccggaattcccgggatatcgtcgacccacgcgtccgcccacgcgtccgataacacacgccggagggtcgcacgcgggttccagttgtgattgctggagttgtgtattgccaggaggctctccgagattggggtcgggtcactgcctcatccaccggagcgatggcgtttctccgaagcatgtggggcgtgctgagtgccctgggaaggtctggagcagagctgtgcaccggctgtggaagtcgactgcgctcccccttcagttttgtgtatttaccgaggtggttttcatctgtcttggcaagttgtccaaagaaacctgtaagttcttaccttcgattttctaaagaacaactacccatatttaaagctcagaacccagatgcaaaaactacagaactaattagaagaattgcccagcgttggagggaacttcctgattc

SEQ ID NO: 11288 - DNA, 644 bp, Homo sapiens
  misc_feature 550, 552, 632: n = A,T,C or G
cagaggttttaaaatgtgtattaaatttcatgggtatgcacagtagagaaggcatcctcacagaggcaagagttccaacctggtgacaatggcagtgagccacccgtctagttttcaaccatctaagatagcagcagctggctgttgcccctggactgagatttcttcctctttgctggtggggggcggctggaacggatgggagacacagtgggaggctgaggccccttgggggtatcattctgtttctggaaggcagctttctcaaaaggctgctctggcaactgctgcttctcaacccccttggcccttccaaggggctgatgatggtccttaggtttcagggtggcctgagtcttggatggggataacacagccggtgtttgtgtgtctgtgcccttgggaggggcattctgcctgaggaaagcaactttcttggaggactgtaatttaggtgatcgttgctttagcttcccagtcacctttggctccctgatcccttcggcttttccagctggctgactgctatcctggaagctgaaggaagctngngtctttgtgacaaaaggtacagtggacaattctgagtctgccccttttgagatgccattcagcttcctggaggaggcctntcttggatggtg

SEQ ID NO: 11289 - DNA, 73 bp, Homo sapiens
gtacagtacaccttgcacccgaaggcagggttacttcatcctatggaaaaggtcccccccaccccggtagcca

SEQ ID NO: 11290 - DNA, 606 bp, Homo sapiens
  misc_feature 420: n = A,T,C or G
gtttttgttgtttttacacaggaatagttaggtctgtcatttgagggagcccaggggacctggaacgggtcacacgggcagtgctcagttctggtgcctcttcatatgcagggccaggtggtcagagcgcgagaagctgcggttgcacaccccgcactggaagggcttggcgcctgtgtgcttccggtagtggcgggtcagctcatccgatcgcgcgaacctccagtcgcagccttcccaggtacacttgtatggcttttcaccagtgtgagtcctcaggtgagcttttaaatgagaagacttggtataaacttttgtgcaaccagggtaatcgcagtagtggatgcgtcgtttctccaaatcggggttactccttctattgtatctgacaggttggatgttttgtgagttaactggcanggtggtgggtaaatttggattgtgaattgccagtttagaagcaattgtagcagcataggatggaggtgggggttaattctggagcatctctgcttgtctatctggactttcaggctctgagcttggtggtgacgggggaaagtcagtgtcctggtgtggaagaaactgacttggcattgtgtatgt

SEQ ID NO: 11291 - DNA, 439 bp, Homo sapiens
  misc_feature 45, 65, 68, 417: n = A,T,C or G
gcgcgctcaccttcactcgcgtgtacagcgggacgcagacatcgnatccagtttggtgtcgcggnacnggagacgggtatccttcgacgggaaggcgggctctggcacacgctttcctcctggccccggcattcagggagacgcccatttcgacgatgacgagttgtggtccctgggcaagggcgtcgtggttccaactcggtttggaaacgcagatggcgcggcctgccacttccccttcatcttcgagggccgctcctactctgcctgcaccaccgacggtcgctccgacggcttgccctggtgcagtaccacggccaactacgacaccgacgaccggtttggcttctgccccagcgagagactctacacccgggacggcaatgcttgatggggaaaccctgccagtttccattnatcttccaaggccaatcctaat

SEQ ID NO: 11292 - DNA, 646 bp, Homo sapiens
ggccgggcactgctacccattctccagtggcacaagcaccccaatgattactttagtaaggaggcatccaaattgtactttaacagcttgaggacttactggcaagagcttatagacctcaacactggtgagtcgactgatattgatgttaaggaggctctaattaatgccttcaagaggcttgataatgacatctccttggaggcgcaagttggtgatcctaattcttttctcaactacctggtgcttcgagtggcattttctggagccactgcttgtgtggcccatgtggatggtgttgaccttcatgtggccaatactggcgatagcagagccatgctgggtgtgcaggaagaggacggctcatggtcagcagtcacgctgtctaatgaccacaatgctcaaaatgaaagagaactagaacggctgaaattggaacatccaaagagtgaggccaagagtgtcgtgaaacaggatcggctgcttggcttgctgatgccatttagggcatttggagatgtaaagttcaaatggagcattgaccttcaaaagagagtgatagaatctggcccagaccagttgaatgacaatgaatataccaagtttattcctcctaattatcacacacctccttatctcactgctg

SEQ ID NO: 11293 - DNA, 650 bp, Homo sapiens
aaagcgctgatcctgtttatttggcaggaaaacgagacaatccagcagcccaggagggacaggtggacttaatcctcctcctcgtcgtctccagccccagccccaccctggcccttcttggcattcttcctcttcacgcggcccgggcggccacccccgtagggagagcgcagagagaagtcgatgtgcttctgggaatccaggcggacaatgaaggacgggatgttcaccacctgcttgcggaccctgatatggcgctggcggatcagcacgcgagcgtggtggatggacttggccaagcccagcttgaagacctgggtctgcaggcgtctctctaagaaatcctctatcttcaggcccaggatgtaatccagcttcatcttgccctcatccagcaccccaatgcggaccagccggcgcagcagggcgttgccttcgaacagacgccgtgggtccttctcatcaagcgtcagcagttcccgggcggccttgcggatcttggccagggtaaatttgaccctccagacctcacgtttgttccggagcccatactcgccgatcagcttcagctcttggtcgagacgagatttctcgaagggtctccgcggggtcacataagttttgcgacaaacccagctccgggccactgg

SEQ ID NO: 11294 - DNA, 522 bp, Homo sapiens
tccaccgcggtggcggccgctctagactagtggatcccccgggctgcaggaattcggcatgagggagcccctgctggtggtggcggccttctacatcctgttcttcaccgttatcatctatgttcggctggacttctccatcaccaaggatccagccgcagaagccaggatgaaggtagcctgcatcacagagcaggtcttgaccctggtcaacaagagaataggcctttaccgtcactttgacgagaccgtcaataggtacaagcaatcccgggacatctccaccctcaacagtggcaagaagagcctggagactgaacacaaggccttgaccagtgagattgcactgctgcagtccaggctgaagacagagggctctgatctgtgcgacagagtgagcgaaatgcagaagctggatgcacaggtcaaggagctggtgctgaagtcggcggtggaggctgagcgcctggtggctggcaagctcaagaaagacacgtacattgagaatgagaagctcatctc

SEQ ID NO: 11295 - DNA, 494 bp, Homo sapiens
cgactcactatagggaaagctggtacgcctgcaggtaccggtccggaattcccgggtcgactactactactaaattcgcggccgcgtcgaccttctggaggaatactgttggcgttcaaaagcattgctgtttcaacaatggccaagaacaaattaagagggccgaagtccaggaatgtatttcacatagccagccaaaaaaaactttaaggctaaaaacaaagcaaaaccagttaccactaatcttaagaagataaacattatgaatgaggaaaaagttaacagagtaaataaagcttttgtaaatgtacaaaaggaacttgcacatttcgcaaaaagcatttcacttgaacctctgcagaaagaactgattcctcagcagcgtcatgaaagcaaaccagttaatgttgatgaagctacaagattaatggctctgttgtaatatactggtgatgcatctaattctccacaaagaccaataaattgaatgtttt

SEQ ID NO: 11296 - DNA, 586 bp, Homo sapiens
ccccgggctgcaggaattcggcacgagtggggctgcctggagcaggtggagaacggctatgaggagtggttgctgaatgagatacggaggctggagcgactggaccacctgtgcaaaaaagttccggcagaaggcctccatccacgaggcctggactgacggcaaagaggccatgctgcgacagaaggactatgagaccgccgccctctcggagatcaaggccttgctcaagaagcatgaggccttcgagagtgacctggctgcccaccacgaccgtgtggagcatattgccgccatcgcacaggagctcaatgagctggactattatgactcacccagtgtcaacgcccgttgacaaaagatctgtgaccagtgggacaatctgggggccctaactcacaagcgaagggaagctctggatcggaccgagaaactgctggagaccattgaccagctgtacttggagtatgccaagcgggctgcacccttcaacaactggatggagggggccatggaggacctgcaggacaccttcattgtgcacaccattgaggagatccagggactgaccacagcccatgagcag

SEQ ID NO: 11297 - DNA, 477 bp, Homo sapiens
tggtacgcctgcaggtaccggtccggaattcccgggtcgactactactactaaattcgcggccgcgtcgaccttctggaggaatactgttggcgttcaaaagcattgctgtttcaacaatggccaagaacaaattaagagggccgaagtccaggaatgtatttcacatagccagccaaaaaaaactttaaggctaaaaacaaagcaaaaccagttaccactaatcttaagaagataaacattatgaatgaggaaaaagttaacagagtaaataaagcttttgtaaatgtacaaaaggaacttgcacatttcgcaaaaagcatttcacttgaacctctgcagaaagaactgattcctcagcagcgtcatgaaagcaaaccagttaatgttgatgaagctacaagattaatggctctgttgtaatatactggtgatgcatctaattctccacaaagaccaataaattgaatgttttata

SEQ ID NO: 11298 - DNA, 576 bp, Homo sapiens
agtcccggtcaccagcaaccatgacggaccagcacgctgaggccaagtcctacctcatcgaagagatgatcgctgagttcaaggctgcctttgacatgtttgatgctgatggtggtggggacatcatcgtcaaggagttgggcacggtgatgaggatgctgggccagacacccaccaaggaggagctggacgccatcatcgaggaggtggatgaggaccgcatcggcaccatcgacttcgaggagttcttggtcatgatggtgcgccagatgaaagaggacgcgaaagggaacagcgaggaggagctggccgagtgcttccgcatcttcgacaggaatgcatacggctacatctacccagaggagctggctgatattttcagggcctccggggagcacgtgacggacgaggagatcgaatctctgatgaaagacggcgacaagaacaacgacggccgcattgacttcgacgagttcctgaagatgatggagggcgtgcagtaaggagtggacagtagcctctaccaagatcgcgtgtccctagggtgtgggagactccgccctgccgggtccccac

SEQ ID NO: 11299 - DNA, 556 bp, Homo sapiens
cttaggagagaggtctaggttgggaatagaaatgtgggtcatcggtgtataaatggcatttaaagccatgaaacccggttaaattacctagggtctaagtacaggtgaaaaagctgtgcaagaagtgagttcttgggaacctccaacattttagagaggagaaccagcaaaggagactcagcaaaaacagctagcaagagtgaggcaaggcagccctgaagccagacacgatgtttcaagaagaagggagagggcaactgtatcaaaggctgctgtgcctcagttaagatgagtgctgggaactggcctcggtttaacgttgaagcacagtgaccttgacaagaacagtttctgaaagcttagttggagtgggcacaagagagcctgaaaggcagagctggagatggtattatagaaagcttttcttgagagcccacagaaatgagtctgtagcttgattagactgtagggtcaaggaaggctgtttgtgatccagtgggagtgatccaggagaagagtggggaaccacagccaggtgtgggcaagggagtacaga

SEQ ID NO: 11300 - DNA, 622 bp, Homo sapiens
attgaaataaggatttaaaggggtatttgtaaactttgccctccttgagaaatatggaactaccttagaggttaagaggaaggcagtgttctgacttctttaggtgatctgaaaaaaacacccttatcctccagtgtaccatctagagatcaccacagaatccatttttttcccagttccacaaaacactctgtttgccttcagtttttactcactagacaataattcaagtttagaaacaggtaatcagctatttgatcttaaaaggcaatgaattgttgggatatcagtgaactatgttgtatacttttgaatttttacattttataaatggaattgaaagttggataactgctttttttaaattttccaacagaagtaacaccacagttgctttgtttctttttatagcttacctgaggttcagttcttctttgtgaacctgtgagtactccacagtttactgggggaaaaggcttcagtaaagcagaggctagaattacagtatttatacatagcaacttttcataaagtagaaaaattcaaaggaagctgtctcaatttgagaataccagctgggcacggtggctcacgcctgtaatcccagcacttactttgggag

SEQ ID NO: 11301 - DNA, 727 bp, Homo sapiens
  misc_feature 1, 5, 7, 14, 20, 27, 29, 33, 37, 58, 85, 87, 91, 94, 104,113, 127, 130, 132, 134, 137, 139, 140, 144, 145, 153, 156,160, 161, 162, 163, 167, 168, 171, 178, 188, 190, 192, 195,203, 206, 211, 215, 216, 227, 230, 236, 241, 243, 248: n = A,T,C or G
  misc_feature 268, 277, 299, 301, 303, 304, 315, 316, 324, 328, 329, 330,343, 345, 346, 347, 352, 357, 359, 369, 376, 379, 383, 385,404, 406, 432, 433, 434, 450, 462, 463, 466, 467, 477, 480,499, 514, 525, 537, 546, 549, 554, 560, 581, 588, 594: n = A,T,C or G
  misc_feature 600, 622, 633, 634, 655, 682, 689, 706, 708, 711, 712, 721,724: n = A,T,C or G
ngggnanggaagtncagcangcacagntnagtngcangctgaatcggctgtgttcaangcatgcccttccatactgcactgaacnancccnttncggcatttanacttgaatntttggctgatattntgngngnaantnntggnntgagcctntcncctnnnngganncanctggtantgttgccagngntnaanctttcaancancactnggannttccgaaattntgnactccnccatnanctttnttgttcgggatattaacaantgtgatttngctaacgaaatgcatttcattngnannaattcaatganncatttttncaannnaccactacgtgangnnncaaantcatncntggctcatanattgatnccnaagngngagacatgcccctggattntnatgtcttaacaatgctgagtgcattnnnttttcagagtctacantgcctttatcannctnngacttgtagnaancctggcgctgtggctcacncctgtaatcccaacnctttgggaggncacgtgggtgcntcacactgncgngggtnaagacnaccctggcaatatggggaagngcggctntctaantacaanagtacctgtcgtggggctgatnccttgtgtccnnctctccggagctgagcaaganaaaccttgacccgtagtggaggtgcangagtcanacctccctggctcactngnccnnaaaaaaaanccnttt

SEQ ID NO: 11302 - DNA, 787 bp, Homo sapiens
  misc_feature 1, 9, 14, 25, 42, 542, 567, 685, 759, 767: n = A,T,C or G
nacgacagnagggnagaagaaaggnactggcccttgaaaaanaaaaggagcaacttcaaaagaagctacaggaagccttaacctcccgcaaggcaattcttaaaaaggcacaggagaaagaaagacatctcagggaggagctaaagcaacagaaagatgactataatcgcttgcaagaacagtttgatgagcaaagcaaggaaaatgagaatattggagaccagctaaggcaactccagattcaagtaagggaatccatagacggaaaactctcaagcacagaccagcaggaatcgtgttcttccactccaggtttagaagaacctttattcaaagccacagaacagcatcacactcaacctgttttagagtccaacttgtgcccagactggccttctcattctgaagatgcgagtgctctgcagggcggaacttctgttgcccagattaaggcccagctgaaggaaatagaggctgagaaagtagagttagaattgaaagttagttctacaacaagtgagcttactaaaaaatcagaagangtattttcagttacaagagcagatnaataaacaggggttagaaatcgagagtctaaagacagtatccatgagcctgaagtcatgccgaagcctgcagcagaattgggaagcagccactacaattgctggctagacatctaaanaattgcacctaactggatgaactgcaaaactctaacaaaagaagaaacgtagctacttctgacaactatggaanaacacttnctaaatcaaagaatataaaa

SEQ ID NO: 11303 - DNA, 739 bp, Homo sapiens
  misc_feature 2, 15, 18, 23, 35, 46, 48, 55, 68, 75, 81, 99, 377, 378,417, 421, 443, 465, 470, 475, 479, 484, 488, 498, 500, 505,508, 513, 514, 524, 527, 532, 562, 568, 597, 599, 603, 637,642, 663, 670, 677, 684, 686, 693, 698, 718, 726, 733: n = A,T,C or G
  misc_feature 735, 737: n = A,T,C or G
anttacttgggtttncgntaaanctttttttgttncttttggccgnancggcctncggctgcgatagncgacagnaggggnatgatctgaaacttcagnattagagaaaaatttcaaatgtgcagcaatagagatgaaaatacagaatgggaaagatgtgatggaaggagaggtgctccagtatttctctgaaagagtgttaaaagaatacaggaaacaataatcaaaaggaggaatgattaacaaaaacagataaatattttcagatggaatgggaggaatacatgagcccaggagttgaagactaccctgggcaacatagtgagaccatgtatttacgtgtgtgtgtgtgtgtgtgtgtgtgtgtgtgtgtgtgnnaccctgggcaacatacaccctgtatttacgtgtgtgtgngcgngcatgtgtgtgtcagggtctcnctcccattgcccacgctggagngcagnggtgngatnataanttcnctgcagcctngnctttncangctcnngtgattcttncanctcantctcccaagtcctgtgactacaggcatacnccaccntgcccatctaatttttctttgtttaatananacangattttgccatgtcccccagggtggtttaaaacntaaanctctgcccccctcaccctctnaaagttntgggatnacaggcntnaatcccnccccngcctttaaaaaaattaaaantacccagnggggggngngncc

SEQ ID NO: 11304 - DNA, 557 bp, Homo sapiens
taagaaatataacacttatatttaatgaattcacttatatttagtgaatattcacttatatttagtgaatagtaggctgggcatggtggcttatgcctgtaatcccagcactttgagtggtcaggagttcaagaccagcctggccaacatggtgaaatcctacctctactaaaaatacaaaaattagctggtatggtggtggacacctgtagtcccagctactcgggaggctgaggcaggagaatcacttgaacccaggaggcggaggtttccgtgagccaagatcgtgccactgcactccagcctcggtgacacagtgagactctatctgaaaataaataaataaataaatgtgaatagtagaaattttggagaataactacatcatagggaccatagaacataatgttcaaatttagtagatctgattacatcagaattaaagatttctgttaaaagaactatacacagagttaaaagtcagatgtcagctttggaacttttaaaacctaaagggaataaatacctgtatatattaagaactcctaaaagttaac

SEQ ID NO: 11305 - DNA, 411 bp, Homo sapiens
tcatgtcactgcacttcaatctgggcgacagagcaagactctgtctcaaaaaaaaaaaaaaaaaaaatggaaatattgggaaacctttgaaattttggaccccacagcctaataatttgaaccggtaagaacggttaaaaaccaacttggccccctgaaaagggggggcttgaaattttaaaatttaaagggttgccttttggtttttggggggaccaaccaaaaaaaaccagggttaactggggggaaaaaggggaaccctttttacccgaacggggaacaactgggggggtcccgaaatccaacgggcccaatgggggcttttggttggcccggatttaacggccgggggaaggaaaaaaaaaaaccccccttgttttttgggtttaaaactaaacctccgggaaaaag

SEQ ID NO: 11306 - DNA, 783 bp, Homo sapiens
  misc_feature 587, 654, 658, 682, 692, 704, 707, 720, 736, 739, 741, 754,765, 774, 779: n = A,T,C or G
atcctagggctaggcatggtggcttacacctctaatcctagcactttgggaggctgaggtgggaggatccgttgagcccaggagttcaagaccagcctgggctatatagtgagaccccatgtctacaaaaaatacaaaaattgaccaggcatggtggtgcacacttgtagacccaggtactctggaggctgaggtggaaaggattgcttgagcacaggaggttgagactgcagtgagtcaagatcatgtcactgcactccagcctgggagacagagtgagaccttgagactttgcatcagaaacaaaacaaaacaaaacaaataaacaaacaaacacgttctggaagtagtatgaatggtaggttgagagatgagggtaaattcaattgagaaagggatgcaaatgagaacataattattagtaatctaaaagagaaatggtgaggggaaatttttaattaagataaagtaaaataatggtgaaatcatgaatttttttattttgtatttcatttttaaaaatcataaccacatgtacacttcattactttagaattggtacttttgaaagaaaaaatagtcatatncattgactctcaaatattcttatgagttatttatactaaatgaatgaaaaaggcagagaatacactntgtntaaatatgagcccaatttttaganccctttgttnaataggctaaanagncgatgggttaganattttagaaaggatgngananatagaaaaacttngggctgggggnggggctccncctgnttcc

SEQ ID NO: 11307 - DNA, 726 bp, Homo sapiens
  misc_feature 3, 421, 426, 430, 431, 433, 440, 445, 451, 462, 470, 471,481, 493, 502, 535, 539, 551, 588, 592, 610, 641, 644, 645,656, 669, 677, 680, 682, 692, 696, 700, 715, 726: n = A,T,C or G
ggnatgctttctgagaagtcaccacttgtaatttcagatcacatacacctgaaggcattttatagttcctaaagttaacatgttagatcttttttttccaccccatgagggtctcactctcacccaggctggaatgcagtggtgtgattgtagcacactttggccaccaactcctgggctcaagtggtcctcctgctttggcctcctctgagaagctgggattactggtgcacaccaccacacctggctaattttttatttttttttatttttggaaatagggtatggctatgttgccttgggcccgtcatgaactcctagcctcaggtgaccctcccacctcaggcctcccaaagggttgggattacaggagtgagctactgcactgggccaacatgttaattttttttttttttttttngaaangganncncccaggnggaantgcaanggggcaatctnaatttcanngaatttttcncctcccgggttnaagcgattntccccctaaccctcctgagtagctgggattaanggcncctgccatcacnctgggttaatttttgttttttgacaaaaaggagtttncccntgtgggcaggggattggnctcccctcccccacctttccaaagggtgggnttnngggttaacccnaaccccctccccnccaaatgnaantntaatttgggntttntccngggggttgggggggnaaaaaaccttn

SEQ ID NO: 11308 - DNA, 256 bp, Homo sapiens
  misc_feature 5, 16, 17, 22, 43, 44, 50, 76, 118, 123, 151, 170, 184, 185,187, 188, 189, 192, 197, 225, 228: n = A,T,C or G
gggtnccgcttctagnncacgntactcgggtacgctgtggcannagaatncgcgtggacccgggctgtgagaattncgccatgaagcctacatcgtgccactgcacattcggaactgngcagntgagtgaaaactccctctcaggtacggntgggagaagacaacagaancggttcgggctgcnntnnnacnacatnaccggtactgctgcgataatactacatnatngtaccgctgccatattacgacagaaggg

SEQ ID NO: 11309 - DNA, 101 bp, Homo sapiens
  misc_feature 17: n = A,T,C or G
ctgcgagaagacgacangagggtacggctgcgagaagacgacagaaggggatccttttgtagttcatgagcgtgatgattgggtgttcatacgcttgtgtg

SEQ ID NO: 11310 - DNA, 524 bp, Homo sapiens
tctggccttgtgtctgtggcactgtagtgagggatggaactcttgggtgggatgtggtaattttggtcgttgcacccaggcctcttgtccgtttctggggaaagataaagacaaggtccatagtcaccctccctaatggtttatactctctctctcctttctttcacacacacacaccccccacacacatgcacagctctccatgcccagctcaccttctcaggctccaggccatcttccatctggtcaggcctcctcttgagtctcttcctgagagaggcagctgggaaggggccttaatcagaggtctcttcagttctatgttcccctttacttccaataggggggacctctgttgggaaaagagacccttaagacaatacccaggagcccaaatgtcccaagaacttcctgtcttggcccccagcctcaattgtcaacaccaccaccaagcactgagcaccacttgtgccaaaagctgaattatgtgccagacagcatgaacagaagtgaggacgtaacct

SEQ ID NO: 11311 - DNA, 751 bp, Homo sapiens
  misc_feature 1, 7, 578, 637, 673, 715, 725, 728: n = A,T,C or G
natcagnactttactgggagttaaacaacatgtgaaaacctccttagctgcgaccacattctttcattttgttttgttttgttttgtttttaaacacctgcttaccccttaaatgcaatttatttacttttaccactgtcacagaaacatccacaagataccagctaggtcagggggtggggaaaacacatacaaaaaggcaagcccatgtcagggcgatcctggttcaaatgtgccatttcccgggttgatgctgccacactttgtagagagtttagcaacacagtgtgcttagtcagcgtaggaatcctcactaaagcaggagaagttccattcaaagtgccaatgatagagtcaacaggaaggttaatgttggaaacacaatcaggtgtggattggtgctactttgaacaaaaggtccccctgtggtcttttgttcaacattgtacaatgtagaactctgtccaacactaatttattttgtcttgagttttactacaagatgagactatggatcccgcatgcctgaattcactaaagccaagggtctgtaagccacgctgctcttctgagacttncattcctttctgattggcacacgtgcagctcatgacaatctgtaggatacaatcagtgnggatttcactcttttcagtccttctgttaagattanacacccatacactggtaaagacgtttcttgaaagtttacttntgtaacttgntanggtatggataaagccattggagg

SEQ ID NO: 11312 - DNA, 200 bp, Homo sapiens
  misc_feature 5, 9, 15, 28, 32, 43, 45, 79, 81, 84, 86, 90, 95, 106, 109,118, 152, 163, 167, 174, 185, 192, 195, 197, 199: n = A,T,C or G
ggggnttgntgacangcttcatggctgnaatngctacctcttncnctaccgtttcttggaaatcccctctggcacttancntcncntccngatanctgaacgggcntgncctccaccncactaaatgcagcgtcctgcgatctcttcaaccnctcctttcctnaaanaccctcntcaagaactgnggccctnctntncnc

SEQ ID NO: 11313 - DNA, 783 bp, Homo sapiens
  misc_feature 1, 505, 601, 666, 672, 673, 681, 685, 687, 717, 719, 726,757, 764, 766, 773: n = A,T,C or G
nggatctgtttcaattttcctttgtcatttatacttgcatttgcctccttttaccctaaccaatttttttctctcatgtgcatatatgtattccctctttcccaacactgtcataattacttcaaataattattcaatcctatcactttcatttttagattttcctttttggggggaggaggattattttctttttaaaaatgttaacaaaatatttcaaacttgcagaatataaccaatatccatgatcctatctctcagaattaattttttaaagaaataaaaacatatatttggagtctcctttgtacttctttccaatcccattcttttccatccaccccaaatccatctactctcctgaaggtggtgcatattattctttttaccatttgtactcttatttatgtgtgctacaaacaatacatttttgtgggttttaacatttgcataaatttgaatatatcctgcatatgattcttcaacttggtttttcctttattgngttttggaaatgtgtctatattgataaatttatatttagctcattgatttaaactacacatggcattacatcacatgattatatcagtatcctttncccaccgatggatgttaatacattactcattttttaccattatgaaaaatttctgtgggcgtggnggctcnncctgtatnccancnctttggagtccaggcggcagatacttgagncnggagtcncctgacacatgggaacccctctttctaagtntaagtancnggggggnggccagcctt

SEQ ID NO: 11314 - DNA, 464 bp, Homo sapiens
cggcacgaggcttccctacctcacctgatggtatccaccgaagggcatttcactaccattaatggtgagtaataaaatcctccgtgttcattcagacctcactgcgtcactactttgaacgcctctgtaagctgtgtcttcactcgccccgaggtgggtggagggaggcctctcactctgcttcgagtcctggtcttaaaggtagtcagaggcagaggctggattaaacacacactgtttaccaagtgccactctcagaccacctgagagacggggggccatcagtaaaattaagaagaatttttttcccttgttcgtgtatgttctgctgatccgtggcctgaaggttcctagagacgtcaagaaatgaatatcttacactgtgattctgtgaagaaagactggtaacccaaaactctcttctctaatgtattttttaacgaaaatgacaatatttctttaat

SEQ ID NO: 11315 - DNA, 522 bp, Homo sapiens
gcggccgctcgttgatcctctgtgggagccgctccagcagccccacggcacgtaccggcacaggaaggacagccactcgagcagaaagcgccgggtcttctccacgccctgcgtgtccgagccccagtgctccaggccgtagttggtgaagtcccgcaggatgtccaggcgctcggacgacgagatgtcccagtgccgctgctccttgatctccgtgaagagccacggcttgagcagggcgccacgggcaatcatgatcccggtgacaccagtctgcatggcgcggttggcatcctcaaatgacaagatgtccccatttccgaacaggggcatggggctggcggcctgcacgcactcctcgatgtactgccagtcggctagcttggtgtagcgctgctcccgagagcggccgtggagctgggggagaagccgccacgcagggtaggaggcagagagtgagacgcagagaggaagagaccaagagagccaggcgtgacgagtgccacgccccagtcccgcagc

SEQ ID NO: 11316 - DNA, 96 bp, Homo sapiens
accccccaaaagggggaccgttggattttttggcctttcaattggcccttttggaaggaacccccaccacaagggggggccaggttttaaaaccca

SEQ ID NO: 11317 - DNA, 513 bp, Homo sapiens
gctgtcttccatctttctcgctcgaatttctctcattaaatcaaaaaataccttgtcaacattagctcgtgttttagcagatgtttccacgtagttaacattccactgctcagctctgttttttgcctcttctacagaaacctgtcttttatcttctaaatctgatttgttaccaaccagtagaaatggaacattctcatcttcttttactcttaaaatctgctccctgaagtcagctgtagctgcaaaggattccatttctgtaatagagaaaacacagaggaacccctccccacttcggaagtagttgtctctaattgcagcgtagtcctcctgcccagctgtatctaagatatcgatctggacttcctccccatctagcactaccttcttccgatagctgtctgctttggtaggctcatagtcctccacaaactcatcgtacatgaactgtagagtcagagctgacttgcccacgccaccactgcccaccatgatgactttgtgtaaagc

SEQ ID NO: 11318 - DNA, 428 bp, Homo sapiens
acaaacaaaatcctattgtatgagcaacacattgttcaactgccagtcagaccaactgctgtaaagaacttatatcaaagtgagaagccacaaaaatggagagtggaaatatatagtgggcaaaaaaagattaatacagtgtggcaactgagtgacagctcacccatagaccatgtgaattttcacaaacctgtatttttctgaattaacactaaacggtagcctggaagaaaggatattgctttactaacatggttacctgcagccaggtgcattacaagtgaagcgtcgctgatgaaatcctctataaggttactgggaggcgggaggcggccatcctgggtcatcagcatgcagacctctattgctgccacctaatggacgcttaataatctctggatacttgtaaattctgagatgcatttgtg

SEQ ID NO: 11319 - DNA, 428 bp, Homo sapiens
ggtatccaagcaggagttactggagctctttaaggagctacacactgggagaaaggtgaaagatgggcaacttacggtcggactggtgggctaccctaatgttggtaagagttcaacaatcaacaccatcatgggcaacaagaaagtatctgtgtctgccacacctggtcacacaaagcactttcagactctctatgtggagcctggcctctgcctgtgtgactgtcctggcttggtgatgccatcttttgtgtctaccaaggcagaaatgacttgcagcggaatcctcccaattgatcagatgagagatcatgttcctcctgtatcactaatatcctttctgctttggaaacactctagttattacgtgcatattagggcttcaggtttattttgggcatttgagggattcagatttgatgaagaat

SEQ ID NO: 11320 - DNA, 577 bp, Homo sapiens
taccacttgccatcctcccagggacacaaggatcgagtccagggacctccctgaaaggcctcagtgccgcccccaccggaagacctttatgccatcattagtggttaagaagcaacgagcaaaaaacctttctgtacgctgagacctctcggtgcacctggtgaccctgggtggaggggacttgctgtgaagtcttcctcgccctctgccctcttgctgcttctccacattgccaggaaaagctgctgacgcctgccctcctctcttgagtcgagggctgaatctttctcctctaagcagtctggtcaggaaccttggtttcttgagaggcccccaagatgccgcagctccagggctcttcctcctcaccagaaatccctgggcttccacaatgtgaactcactcattgtcaggtgtccgtggagtgtttttggcatggtgacctgtctgggcccagcatgttgcagatgtgtatttatgcgcaatggtatgcatatctctgtgtgactgtcagtgttgcaagctggctggatccaactatctcttctgaaataatgcatccaaagggttgatattc

SEQ ID NO: 11321 - DNA, 573 bp, Homo sapiens
agaaccaggcagcccagaaaccccaggcgtggagattgatcctgcgagggaagggggttcatcatggcggatgacctaaagcgattcttgtataaaaagttaccaagtgttgaagggctccatgccattgttgtgtcagatagagatggagtacctgttattaaagtggcaaatgacaatgctccagagcatgctttgcgacctggtttcttatccacttttgcccttgcaacagaccaaggaagcaaacttggactttccaaaaataaaagtatcatctgttactataacacctaccaggtggttcaatttaatcgtttacctttggtggtgagtttcatagccagcagcagtgccaatacaggactaattgtcagcctagaaaaggaacttgctccattgtttgaagaactgagacaagttgtggaagtttcttaatctgacagtggtttcagtgtgtaccttatcttcattataacaacacaatatcaatccagcaatctttagactacaataatacttttatccatgtgctcaagaaagggcccctttttccaacttatactaaagagc

SEQ ID NO: 11322 - DNA, 140 bp, Homo sapiens
caagctacttgttctttttgcaggatcccatcgattcgaattcggcacgaggggattaacaatgctgaaggactcttagtagtagtgactgtgatctgtgcccctctgactttcctgagcctgacacacaacctgtgggc

SEQ ID NO: 11323 - DNA, 186 bp, Homo sapiens
  misc_feature 4, 6, 18, 25, 40, 51, 59, 61, 72, 74, 86, 88, 106, 113, 117,129, 133, 136, 151, 173, 174, 176: n = A,T,C or G
ggtncngctgcttataanacgacanaatggttcggctgcnataatacgacncaatggtncngctgctataanangactgaagggtncngctgctataagacgacanaatggtnctgntgctataatacnacanaanggttcggctgctatnaaccacttaatggttccgctgnnanaatacgacat

SEQ ID NO: 11324 - DNA, 864 bp, Homo sapiens
  misc_feature 5, 23, 35, 46, 48, 64, 65, 77, 79, 100, 705, 785, 804, 805,823, 828, 847, 848, 850, 862: n = A,T,C or G
ataanttgaccaaacgataaaancttgtcttgttncttttggccgnancggcctacggctgcgnntagtacgacagnangggagctttcctcatgcaaangattttgtatccccggcctacttgaagaagtggtcagctaaaggaatccaggttgttggttggactgttaatacctttgatgaaaagagttactacgaatcccatcttggttccagctatatcactgacagcatggtagaagactgcgaacctcacttctagactttcacggtgggacgaaacgggttcagaaactgccaggggcctcatacagggatatcaaaataccctttgtgctagcccaggccctggggaatcaggtgactcacacaaatgcaatagttggtcactgcatttttacctgaaccaaagctaaacccggtgttgccaccatgcaccatggcatgccagagttcaacactgttgctcttgaaaatctgggtctgaaaaaacgcacaagagcccctgccctgccctagctgaggcacacagggagacccagtgaggataagcacagattgaattgtacagtttgcagatgcagatgtaaatgcatgggacatgcatgataactcagagttgacattttaaaacttgccacacttatttcaaatatttgtactcagctatgttaacatgtactgtagacatcaaacttgtggccntactaataaaattattaaaaggagcactaaaggaaaactgtgtgccaagcatatcctaaggctacggaattggggaaccncatgcatccatgaggcttnntgtcagcaccaaatgganggagnctgaccatgaggattatanntntgataaaactgnac

SEQ ID NO: 11325 - DNA, 692 bp, Homo sapiens
  misc_feature 505, 567, 586, 614, 624, 632, 633, 646, 647, 653, 656, 657,664, 681, 689, 690, 691: n = A,T,C or G
aggggagcatgcgctccggctccaccacgaacatgtagtagaggttccacatcagcatcgacagcagtggcagaaacgtcaggccgtagccgaagcctcggaaggagcggcccacggcaaagagacatggtcttgctatgttgccagtctgggctcaaacttctggccttgagtgattctctcacctcagactcctgagtagctgggattacagatgcgggccaccacacctggctgtacaaactttaaaatgtttgagcaaattcaatgagtatagtaaaatatcttcctccctttaccgattcccaccctattctcccccacccccaccccaggcatcaatattatggtttcttgtgcactgagtgattttttaaattattattatttttttatttttgagacagagtctctctctgtcacccaggctggagtgcagtggtgcgatctcagctcactgcaacctccgcctcccgggttcaagcaattctcctgcctcagcctnctgagtagctgagactacgggcgcccgccaccatgcctggcttttttttgtatttttagtanagatggggtttcacccganatggtctcatctcctgacctgagatccncctgccttgnctcccaanngctggatacagcnngagccnccnnctggctntttttttttttttaatntaaagggnnnt

SEQ ID NO: 11326 - DNA, 489 bp, Homo sapiens
  misc_feature 139: n = A,T,C or G
ctggtaccggtccgggattcccgggatatcgtcgacccacgcgtccgggcggcgtttggatgattgtctctcggcggcggagtcggtgagcggcccggcggggcgcggggtgcggagcgggggcggctgtgcgtgcganagtggcaggtaacactgtggtgacactatctctgtcatgcatcaaacttataaaattggctgggcatggtggtgcatgcctgtaatcccagctacttggaaggctgaggctggagaatcacttgaatccaggagacggaggttgcagtgagcagagattgcaccactgcactccagactgggcaacacggcaagactccgtctccatagaaacaaaaaaacaaaacttacatatgtgtataagcctgtgtcaggattctgtacttttccttttatctacaggttgcatatttatatttcttcagtaatatatgctgtttcaagtactacagctttatattaagccttatt

SEQ ID NO: 11327 - DNA, 82 bp, Homo sapiens
tgacactataggaacaagtttgtacaaaaaacaggctggtaccggtccggaattcccgggatatcgtcgacccacgcgtccg

SEQ ID NO: 11328 - DNA, 437 bp, Homo sapiens
acaagtttgtacaaaaaagcggctggtaccggtccggaattcccgggatatcgtcgacccacgcgtccgcccacgcgtacggtggggaacatgtctgagtcggagctcggcaggaagtgggaccggtgtctggcggatgcggtcgtgaagataggtactggttttggattaggaattgttttctcacttaccttctttaaaagaagaatgtggccattagccttcggttctggcatgggattaggaatggcttattccaactgtcagcatgatttccaggctccatatcttctacatggaaaatatgtcaaagagcaggagcagtgacttcacctgagaacatcccagcgggaggacaagagaaatcatgtttattcctcaggaatactgaagtgccctggagtaagctgccattcttctgtaacaatgttatcagt

SEQ ID NO: 11329 - DNA, 323 bp, Homo sapiens
  misc_feature 286: n = A,T,C or G
ttttgctgtgaaaatactctgtttattaaagaccaggcggagggaggtaaggttgtgggttctgtatgggaaactgagtcccagccccagggagggagaaggaggacggaccagctggcagcctgcgagaggtcacaggtcagtggccggaccccagtcatagccgtcttcatcggaggactccgcatcatggactcgcgtaaactttttcttcagggcttcccgttcataggttcgcatgctgtcctgtcgccactgtcccctggggtggcggctgtccacctgngccccctgatgagccgagattctcccacgatccctcg

SEQ ID NO: 11330 - DNA, 672 bp, Homo sapiens
ctatttaggtgacactatagaacaagtttgtacaaaaaagcaggctggtaccggtccggaattcccgggatatcgtcgacccacgcgtccgcccagccttgggattcccaagtgttttcattcagtgatcgggactgaacacagaggactcaccatggagtttgggctgaattggattttccttgccgctattctaaaaggtgtccagtgtgaggtacagctggtgcagtcggggggaggcttggtcaagccgggggggtcccttagagtctcctgtgcaccctctggaatcgctctcaataacgcctggatgggttgggtccgccaggctccagggagggggctggagtgggtaggccgcattagaagcaaaggcgaaggtgagaaaacagactacgctgcatccgtcaaagggagattcaccatctcaagagatgattcaaggaacaagttggacctgcaaatgaacaccctgaaaaccgaggacacagccgtctattactgcaccaacctacctccttatgatagtagtggccattactactttaccgagtggggcaggggaaccctggtctccgtctcgtcagcttccaccaagggcccatcggtcttccccctggcgccctgctccaggagcacctctgggggcacagcggccctgggctgcctggt

SEQ ID NO: 11331 - DNA, 523 bp, Homo sapiens
  misc_feature 12: n = A,T,C or G
atgtgttggcgngcaggtagaggcgctccaggttggtgaggttgccgatctggatggggatgtaggcgatgtggttgtaccacagcttaaggcaggtgaggcggtgcaggtgctggaagctgatgatctcctcgatggtcttgaggttgttgtccttgaggtcaatctcctgcaggttgtggaggctgaaaatggagtgggggatgcgctccaggtcacagcggatcagctccagctcagtcaggttcgccatcttcttgaggctgttgaggacgatgagcttggtgccctcattgttgatggacagcttctgcaggtgcacgcccacatctgtgaccacctgtggcagcttgcttaggttgctcttgagccgcagcaccttgaggcgtttgagctcccgcagcccgtcgatgacgatgtagcggttgttctccgcgctcaggttgcccgtcaagtgcagctccttcagtgtcttcaagctatagatccacagcgggatcttccttgtgtcggtgaacttgat

SEQ ID NO: 11332 - DNA, 59 bp, Homo sapiens
agtttgtacaaaaaacaggctggtaccggtccggaattcccgggatatcgtcgacccac

SEQ ID NO: 11333 - DNA, 527 bp, Homo sapiens; identical to SEQ ID NO: 3022

SEQ ID NO: 11334 - DNA, 594 bp, Homo sapiens; identical to SEQ ID NO: 3023

SEQ ID NO: 11335 - DNA, 517 bp, Homo sapiens
cccacctcacctctggcacctctgagcatccacgtacttgcaagaactcttgctcacatcagctaagagattgcacctgctgacctagagattccggcctgtgctcctgtgctgctgagcagggcaaccagtagcaccatgtctgtgactggcgggaagatggcaccgtccctcacccaggagatcctcagccacctgggcctggccagcaagactgcagcgtgggggaccctgggcaccctcaggaccttcttgaacttcagcgtggacaaggatgcgcagaggctactgagggccattactggccaaggcgtggaccgcagtgccattgtggacgtgctgaccaaccggagcagagagcaaaggcagctcatctcacgaaacttccaggagcgcacccaacaggacctgatgaagtctctacaggcagcactttccggcaacctggagaggattgtgatggctctgctgcagcccacagcccagtttgacgcccaggaattgaggacagctctga

SEQ ID NO: 11336 - DNA, 380 bp, Homo sapiens
  misc_feature 63, 180, 192, 241, 242, 245, 246, 248, 250, 266, 267, 274,278, 337, 366: n = A,T,C or G
actgaaaagaagatagtgccatttgaaacaacagatgcatcttttatacattttcacaagttngtttttcatatttttaaaggccccatttatctgtaacagtggtatttttatttagagtatcggctacttaatatatacatgcaacaatatatgctttaatagtcatttaacttttangaatatttcatnacattaagtggttaagcatagcgttaaaagagtggaatataaggaatannaanntntngaaaatacgctgctannttcattngcanactatagtagaatggagatgcccataaaagtgatcattgcccaactgaattcctacccngaactaacatgtgattctcaagtgggganaaatattattaaaa

SEQ ID NO: 11337 - DNA, 506 bp, Homo sapiens; identical to SEQ ID NO: 3025

SEQ ID NO: 11338 - DNA, 365 bp, Homo sapiens; identical to SEQ ID NO: 3026

SEQ ID NO: 11339 - DNA, 632 bp, Homo sapiens; identical to SEQ ID NO: 3027

SEQ ID NO: 11340 - DNA, 710 bp, Homo sapiens
  misc_feature 475, 574, 581, 606, 617, 638, 706: n = A,T,C or G
tgccctaacccctgggatgcagcctgcctttccataaagtcacctaggtgaggataggcgcgggagcctcggcatgacaccatggagatcggggccctcttcccagtgggttcactccttttcacacctgctgggtccctcctcacccagcaggcctggtccacctctcattgcaagccccaagcactgagccagcaggtgccagggagccacccgccccccatagcttctgcacacctcagactcaccccatcaccttggcagcaaagcactggctctgccgtctgacccctgatccaggcagccccctccgcagagaaaagggttggggagaagcctctgcagtcctggaagatgtggggtgctgggtgagaggcatcagcccccacaagtatgtttttgtgtcttaagatagcagtttactttgaaaaagtgaaaaaggcttccgggctgtcctctgcccagtgagatggangacgctagagaaagtgctgagtgtcccgagagaggcccccgaccagtgcatggaggtccttcgcctggctcagctgggctgcaggatgcccactttgangaaggangcacaaggcttgggccaaggggcanaaggccatcanaacttgcccggcttttttggnaaacttgaggaccccaaccaactaaccacgtttacacgaacttgagtttttgaaccccgatttaatgncttg

SEQ ID NO: 11341 - DNA, 403 bp, Homo sapiens
cgttgctgtcggcgcggagaggagaggcctcgggatgtctctggcagatgagctcttagctgatctcgaagaggcagcagaagaggaggaaggaggaagctatggggaggaagaagaggagccagcgatcgaggatgtgcaggaggagacacagctggatctttccggggattcagtcaagaccatcgccaagctatgggatagtaagatgtttgctgagattatgatgaagattgaggagtatatcagcaagcaagccaaagcttcagaagtgatgggaccagtggaggccgcgcctgaataccgcgtcatcgtggatgccaacaacctgaccgtggagatcgaaaacgagctgaacatcatccataagttcatccgggataagtactcaaagagattccct

SEQ ID NO: 11342 - DNA, 750 bp, Homo sapiens
  misc_feature 24, 668, 710, 713, 727: n = A,T,C or G
ctagatcagctctttcaaatatgnaggatccctcgattcgggctctgcttttaaagatatggctgcttcaaaggccagagtcacaggaaggacttcttccagggagattagtggtgatggagaggagagttaaaatgacctcatgtccttcttgtccacggttttgttgagttttcactcttctaatgcaagggtctcacactgtgaaccacttaggatgtgatcactttcaggtggccaggaatgttgaatgtctttggctcagttcatttaaaaaagatatctatttgaaagttctcagagttgtacatatgtttcacagtacaggatctgtacataaaagtttctttcctaaaccattcaccaagagccaatatctaggcattttcttggtagcacaaattttcttattgcttagaaaattgtcctccttgttatttctgtttgtaagacttaagtgagttaggtctttaaggaaagcaacgctcctctgaaatgcttgtcttttttctgttgccgaaatagctggtcctttttcgggagttagatgtatagagtgtttgtatgtaaacatttcttgtaggcatcaccatgaacaaagatatattttctatttattattatatgtgcacttcaagaagtcacttgtcagagaaataaagaattgncttaaatgtcatgattggaaaatgtcctttgcattgcttggnaangggtgtacctaaanccaggaaaatggctctggtttgg

SEQ ID NO: 11343 - DNA, 349 bp, Homo sapiens
cccccaggactgtcagctccccttcccacagagcacccacctggaggtgtcacctgccggcaagcgtgggccattcatccacctgtcagtcaacaacacccgctgagcatcggcttgtatcaaaaggtccagacctaaggggaaattttatctctttctttctttctttcttttttttttgacacaaagttttgctcttgttgcccaggctggagtgcaatgacacgatctcggttcactgcaacctctgcctcctgggttcaagcgattctcctgcctcagcctcccgagtagctgggattacaggcgcccgccatcacgcccgggaaatttttttgtattgttggga

SEQ ID NO: 11344 - DNA, 579 bp, Homo sapiens; identical to SEQ ID NO: 3029

SEQ ID NO: 11345 - DNA, 513 bp, Homo sapiens
ttccgttgctgtcggggacttcagcatggcggtgtttgcagatttggacctgcgagcgggttctgacctgaaggctctgcgcggacttgtggagacagccgctcaccttggctattcagttgttgctatcaatcatatcgttgactctaaggaaaagaaacaggaaattgaaaaaccagtggctgtttctgaactcttcacaactttgccaattgtacagggaaaatcaagaccaattaaaattttaactagattaacaattattgtctcggatccatctcactgcaatgttttgagagcaacttcttcaagggcccggctctatgatgttgttgcaggttttccaaagacagaaaagctttttcatattgcttgcacacatttagatgtggatttagtctgcataactgtaacagagaaactaccattttacttcaaaagacctcctattaatgtggcgattgaccgaggcctggcttttgaacttgtctatagccctgctatcaaagactc

SEQ ID NO: 11346 - DNA, 342 bp, Homo sapiens; identical to SEQ ID NO: 3030

SEQ ID NO: 11347 - DNA, 209 bp, Homo sapiens
tgcaaactctagctgcagcatgtggagcttctatatgtttactaccttgaatggttgtcagtgtcactgaaccacaggggagaggagtatggggtacatcaatggtctgtgccaacgaatggtgagcttagggtcttactctgactccttactcctcaaggaggcagttagggtccctcttaagcaggcttctatgtcttaccactaaa

SEQ ID NO: 11348 - DNA, 663 bp, Homo sapiens
ctgtctggggccaaggttgccagagatttctgaagacacagcttgttccttgttcttggctggtgggtgcacaaggacttctggaagggatttagacggggctgagtgctaggattaaagtggggatgggagtacggcaacagaaaaacctgggagctagcaatgcacccagcccttgactgtgccctggtggacagccgagctgtggctctagcgtgagccagtgccttcctgtccctgccaagggtgaggccagagttggccccgaggctaatgtttcagtgggtgagattaggtcggccgtacagaggccggtgggctccctgacatcccttccaggcaacctgaaagcactgaaatagcttatggccctgtgccagggaccttggcccaagctgctgacctccagggtggggagggagctacccccaggagaagagtcactcagacagcagtatgagcaagccagccagcagctccgtgcctgcacccagctcaggggaatcccagggggttcagatgcccaggaaggaaaaggggacagcgctactgctatggaatgagaccaccacttctcctgttgtccttcccagcttctccccaacctccccttttccctagtttataagacaggagaaaagggagaaagcaaaaagctggaaa

SEQ ID NO: 11349 - DNA, 522 bp, Homo sapiens
tccgttgctgtcgcacgaacacagatagaaagaaggaaaacaagcctgtatttttccagcaaatataacacagaagctcttagccccccacgacgtaaagcctttaagaaatggacacctcctcggtcaccttttaatctcgttcaagaaacactttttcatgatccatggaagcttctcatcgctactatatttctcaatcggacctcaggcaaaatggcaatacctgtgctttggaagtttctggagaagtatccttcagctgaggtagcaagaaccgcagactggagagatgtgtcagaacttcttaaacctcttggtctctacgatcttcgggcaaaaaccattgtcaagttctcagatgaatacctgacaaagcagtggaagtatccaattgagcttcatgggattggtaaatatggcaacgactcttaccgaattttttgtgtcaatgagtggaagcaggtgcaccctgaagaccacaaattaaataaatatcatgactggctttgggaaaatcat

SEQ ID NO: 11350 - DNA, 363 bp, Homo sapiens; identical to SEQ ID NO: 3032

SEQ ID NO: 11351 - DNA, 105 bp, Homo sapiens
gaattccgttgctgtcggaagaattcgcggccgaggagtttttttttttttttttttcaccaaaccatggggagagctacaaaaggtatcctttcttattttcag

SEQ ID NO: 11352 - DNA, 511 bp, Homo sapiens
ttccgttgctgtcgccagcttctgccagcccctggcctttactttcttccttgcctatgcagggcaaacaaaatgtgaaattctgccctcagctgagctgagtaagggctcctgggggttggctggagatgggtgtggcatctgtccaggcctggaaccgtctcaagacagtgctggcaaagctgcagtattgagatgctaaggagctgatgccacctctttgtcttcccctaaaggagaacatggggataacatgggtgtgtgcccacaacactctaggtgcagagcccctgtggcaaagtattacagggtgtgggtggggattaccctgaatcggggattttaatgatggaagcaggcagagcctggtgggtgattctgtcaacagaaaattgcaatcatgcaggggctgggagggttaggatgaaaaaactggggccattggaggcccactgtaggtgggagggagctgattttggggtggggggtgggactagagggcaatactgaa

SEQ ID NO: 11353 - DNA, 384 bp, Homo sapiens
gtcggatccattcagtcacggttcctgcagagtctgaatctaaactgtatagcactatgtgaagtgattacatctaaggacctgcacaagcatgggaacatctgggtgtgccctgtgtcctaccatgtctgcacaagattcttctttgtatatgatgatggacacgtgggctatgccaacattaatactcaggaccccaagatacagaatgaaatcatgcgtgtgatcggaactcaggtttacacaaactgacggggcccgatccctcgtaccacccctgttaccccaggatccatctgccctcataaaagtgttcaagtacagcagctgaggctgccctgaggaatcaaggggccattaccaatgggcaggaaaaggatatgt

SEQ ID NO: 11354 - DNA, 405 bp, Homo sapiens
cgttgctgtcgaagcggctccgtgacggagcggcggtgcgcgcggcagggcccggagtatcccgctttctttggaggaaaccaccgcatcagatctgcgctgcggcagaggcaggctacaaccactagcacggctgacgatggccctttctgcggagaccgagtcacacatctaccgagctctgcgtactgcttctggcgctgccgcccaccttgtggccctgggctttaccatctttgtggctgtgcttgccaggcctggctccagcctgttctcctggcacccggtgcttatgtctttggctttctccttcctgatgaccgaggcactactggtgttttctcctgagagttcgctgctgcactccctctcacggaaaggccgagcacgctgccactgggtgct

SEQ ID NO: 11355 - DNA, 300 bp, Homo sapiens
aattccgttgctgtcggaaacaggcctgaggtcacatttcacttagtggttgtgttgggaccaaaacctgggtgtcctcactgctgccctgagtccagccatggttttcagggggacagtggacagggactcagaaatgtggtgggagggcctccctggcttgggagaccgctctctgcaagggagggggagagaagcagagggagagagaaggtgacacggatggaagagtgggaaggagctggcctggctcagccctaggctgtccctgcagccagggtgtccgggggctggccagtc

SEQ ID NO: 11356 - DNA, 354 bp, Homo sapiens
tgccggtggagcccgagtctgactccggggacgaggaagaggaggggcccattgtgctgggcagacgacaaaaagctttggggaagaaccgcagtgctgatttcaaccctgatttcgttttcactgagaaggaggggacgtacgatggcagctgggccctggctgatgtcatgagccaactcaagaagaagagggcagccactacattagatgagaagattgagaaagttcgaaagaaaaggaaaacagaggattaagaagccaagtctgggaagttggaaaaggagaaagaagcaaaggaaggctctgaaccaaaggagcaggaagaccttcaagagaatgatgaggaaggct

SEQ ID NO: 11357 - DNA, 368 bp, Homo sapiens; identical to SEQ ID NO: 3033

SEQ ID NO: 11358 - DNA, 529 bp, Homo sapiens
gtgggagagtcagaactaagggaatgagtatgggcggcccctcataaaggaccttaaaggcagggaacagcaatgccaaatttccctctctcgtgagatgggggatgctgtgcaggctgctgaggcacccatgagaaacgccgaaagagcatgcatcttacaaatagcccctcaattccaggagtcaacatgccatacaatgaggctggagacaggtagctccgagggaggacttctggcatgagatctcggcatggcaagcccagcatcgcctcatcccagacaggctccaccaggagatcaagcaagggctgcctttcaggagtcacctcctgagccacttgatagttctggaagtgaccaccgaccacggtggaggaatagactactagttcattctgggacacttgatccagagagtagaaagcttggaaagaccagataagacacctgccctttgtctgcctaaggacatgagacaccacattccatatgtgctagaaaaacctatccactgatgagtctaact

SEQ ID NO: 11359 - DNA, 664 bp, Homo sapiens
  misc_feature 496: n = A,T,C or G
aggtgcctgcgctggggcctgagccgagccggagtctggctgctcccaccgcccgcacggtgcccacgccgggcgctgcacaagcagaaagacggcactgagttcaagagcatctacagcctggacaagctctaccccgaatctcagggctcggacaccgcctggagggtcccgaatggtgcaaagcaagccgacagtgacatccctctagatcgcttgacaatatcttattgtcggagtagtggtcctggggggcagaatgtgaacaaagtgaattccaaggcagaagtcaggttccatttggcaactgccgagtggatcgcggagcccgtgcggcagaagatagccatcacgcataaaaacaagatcaacaggttaggagagttgatcctcacctctgagagcagccgctatcagttccggaatctggcagattgcctgcagaaaattcgagaaatgatcactgaggccagccagacaccgaaggagccaacanaagaagatgttaaacttcatagaatcaggatagaaaacatgaatcgggaaaggctgagacaaaagagaattcattctgctgtaaagacaagcaggaagggtcgacatggactgaaatcaccctctgcagctgggagggctcttctggggcgtccgggcagctgcagct

SEQ ID NO: 11360 - DNA, 591 bp, Homo sapiens
gtccccgccatgtctgcggccatgagggagaggttcgaccggttcctgcacgagaagaactgcatgactgaccttctggccaagctcgaggccaaaaccggcgtgaacaggagcttcatcgctcttggtgtcatcggactggtggccttgtacctggtgttcggttatggagcctctctcctctgcaacctgataggatttggctacccagcctacatctcaattaaagctatagagagtcccaacaaagaagatgatacccagtggctgacctactgggtagtgtatggtgtgttcagcattgctgaattcttctctgatatcttcctgtcatggttccccttctactacatgctgaagtgtggcttcctgttgtggtgcatggccccgagcccttctaatggggctgaactgctctacaagcgcatcatccgtcctttcttcctgaagcacgagtcccagatggacagtgtggtcaaggaccttaaagacaaggccaaagagactgcagatgccatcactaaagaagcgaagaaagctaccgtgaatttactgggtgaagaaaagaagagcacctaaaccagactggat

SEQ ID NO: 11361 - DNA, 578 bp, Homo sapiens
gccgggcaccgcggccatggagggtcaacgctggctgccgctggaggccaatcccgaggtcaccaaccagtttcttaaacaattaggtctacatcctaactggcaattcgttgatgtatatggaatggatcctgaactccttagcatggtaccaagaccagtctgtgcagtcttacttctctttcctattacagaaaagtatgaagtattcagaacagaagaggaagaaaaaataaaatctcagggacaagatgttacatcatcagtatatttcatgaagcaaacaatcagcaatgcctgtggaacaattggactgattcatgctattgcaaacaataaagacaagatgcactttgaatctggatcaaccttgaaaaaattcctggaggaatctgtgtcaatgagccctgaagaacgagccagatacctggagaactatgatgccatccgagttactcatgagaccagtgcccatgaaggtcagactgaggcaccaagtatagatgagaaagtagatcttcattttattgcattagttcatgtagatgggcatctctatgaattagatgggcggaagc

SEQ ID NO: 11362 - DNA, 581 bp, Homo sapiens
agccctgtcaaccagctccgagccggcagcgaaacctgaagtggaccctgtggaaaatgaagctgtcgccccagaattcaccaaccggaacccccggaacctggagcttttatctgtagccaggaaagagcggggctggcggacggtgtttccctcccgtgagttctggcacaggttgcgagttataaggactcagcatcatgtagaagcacttgtggagcatcagaatggcaaggttgtggtttcggcctccactcgtgagtgggctattaaaaagcacctttatagtaccagaaatgtggtggcttgtgagagtataggacgagtgctggcacagagatgcttagaggcgggaatcaacttcatggtctaccaaccaaccccgtgggaggcagcctcagactcgatgaaacgactacaaagtgccatgacagaaggtggtgtgggtctacgggaacctcagagaatctatgaataaatggaagcattaattggtttgaacatgtaaatataaatctgtcagccactacagccatcaaaagagagcatctggaagaacagccagcttggaagttttacag

SEQ ID NO: 11363 - DNA, 248 bp, Homo sapiens
ccggggtaaaaaatgtaccccattttttgccacctaatgggctacaccttgacctaacgtctttacgggggtacttgcgcttactttgtacccttcataagggtttgctgaaaatggcggtttttaggctgaccaaaagggggggaggttgatcggggtttatcaattacaaaacaggctcctctaaagggatataaaccccccccaggccctttgagttttaacctggggctcgaagggttctggca

SEQ ID NO: 11364 - DNA, 505 bp, Homo sapiens
ccgttgctgtcggtaacttgcaaaaagtagacttggtgtgaagactcacttctcagctgaaattatatatatacacatatatatatatattttacatctgggatcatgatagacttgttagggcttcaaggccctcagagatgatcagtccaaatgaacgaccttacaaatgaggaaaccaagataaatgagctgccagaatcaggtttccaatcaacagcagtgagttgggattggacagtagaatttcaatgtccagtgagtgaggttcttgtaccacttcatcaaaatcatggatcttggctgggtgcggtgcctcatgcctgtaatcctagcactttgggaggctgaggcaggcaatcacttgaggtcaggagttcgagaccagcctggccatcatggcgaaacctcatctctactaaaaatacaaaagttaaccaggtgtgtggtgcacgtttgtaatcccagttactcaggaggctgaggcacaagaattgagtatcac

SEQ ID NO: 11365 - DNA, 603 bp, Homo sapiens
ccgttgctgtcggctcctggccccttggctggccgggctgtttctggccatgggtcgctcccgccggacaggcgcgcaccgagcgcactctctagcccggcagatgaaggcgaagcggcggcggccggacttggatgagattcaccgcgagctgcggcctcagggatccgcacgaccccagcccgacccaaacgccgagttcgaccccgacctgccagggggcggtctgcaccgctgtctggcctgcgcgaggtacttcatcgattccaccaacctgaagacccacttccgatccaaagaccacaagaaaaggctgaagcagctgagcgtcgagccctacagtcaggaagaggcggagagggcagcgggtatgggatcctatgtgccccccaggcggctggcagtgcccacggaagtgtccactgaggtccctgagatggatacctctacctgacatggcctgaagatgcagggcagaggaattgcccatggacagtgacgcaaggactaggctgggagggagcgtgccaaccccttttgcctctgggtttggggagcggagggcctcttcttggtgccctgcccccaataaaggaactggac

SEQ ID NO: 11366 - DNA, 396 bp, Homo sapiens
ccgttgctgtcgctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctctctg

SEQ ID NO: 11367 - DNA, 422 bp, Homo sapiens
ttccgttgctgtcgcttaatccaatgggtttttccctgtacagtagattttccaaatgtaataaactttaatataaagtagtcctgtgaatgccactgccttcgcttcttgcctctgtgctgtgtgtgacgtgaccggacttttctgcaaacaccaacatgttgggaaacttggctcgaatctctgtgccttcgtctttcccatggggagggattctggttccagggtccctctgtgtatttgcttttttgttttggctgaaattctcctggaggtcggtaggttcagccaaggttttataaggctgatgtcaatttctgtgttgccaagctccaagccccatcttctaaatggcaaaggaaggtggatggccccagcacagcttgacctgaggctgtggtcacagcggaggtgtggagccg

SEQ ID NO: 11368 - DNA, 462 bp, Homo sapiens
tactggactggaagcaggagacagaacagtgtctgtcccggggtgacttcatcaggagaccgcccacatagagctggaccccgcagctgaagcggaaatgtgagacaggctggcacctccggaaaaactgcctttcagccttggtgttccgtgcaaggtgaaaagaaataggtcctcccagtttacagcttgaaatcaggctagtgagtggccctggagaccacgaggggagaatttaaaggccccggctggcagggtctaggtggctggcagaggcacatgcagaccctgcctggagcctgccctaggacgctgggcgggtcagtctccgtgcaggatgtgagcagcgtccctgggctctatccgcgaggtgccagtagcgtgtgcaggtacatacacgtgcgtgcacactgtgatgacacccggaaatgtctcacgatgttgaaatgtgtccttgggggc

SEQ ID NO: 11369 - DNA, 555 bp, Homo sapiens
ggcttgcctggcttggctgcagtgcactttgaaatgaagtatctgtcctttggcccagcccctggtttgcttgtagaaaacatggtaggcttccccaaggcatctgcagggaactttggcagcttggggcaccctgaattagcaaaaatggggggtgatgaggtgctgaagaaggatacttaacagcttagtgaggaggcaagagctcctctgggaccaccacttcttcaggagagggcctgtgggcttgcttttggaaggcctcaggcagacacgtgccctctgggtgatgtctgtctgctgccaggatggagcagaggagcgccacacatggaggaaagcccctgtaacgttacctaccttaaactccactcatcaaatctgagaaaagtatccactggtccccagggtttcagtcatgcttttgggggtcattgggtattagagaagtaagtatcttttctgagagagggggagtcaccccccctactggggattcctctgggctttattcactcccagccctggccctgacctttgtgggcctccctaatg

SEQ ID NO: 11370 - DNA, 338 bp, Homo sapiens
ggcacgaggtcaaaagctgtcgaaaccgttcacaatttgtgttgcaacgagaacaaaggggcctctgaactagtggcagaattgagcacactttatcagtgtattaggtttccagtggtagcaatgggtgtgctgaagtgggtggattggactgtatcagaaccaaggtactttcagctgcagactgaccatacccctgtccacctggcgttgctggatgagatcagcacctgccaccagctcctgcacccccaggtcctgcagctgcttgttaagctttttgagactgagcactcccagctggacgtgatggagcagcttgagttgaagaagacact

SEQ ID NO: 11371 - DNA, 376 bp, Homo sapiens
cgttgctgtcgatgctatttgcgttctccagatgtttattgaagatacagatcctaattggttacccagtttgaccctaatcatatgtatattttattgatttcagtttgcaatttttaatttatgttcttatgatggtttaaacctatagtcaggcttttaagtacaagtttgtttaagtgccagactttgaggatcagttttaatttctccatttgtaatagctgggtatttaaactggaagcaaatagttttctttcttaacaattatgtgcagtgtgtgtcactgttttcttgctttatagatagagctggctttaagtgctaaaggacacagtagatttttgacaaacagtggctgctctgctgactatct

SEQ ID NO: 11372 - DNA, 432 bp, Homo sapiens
attgtgtgtgccttttatgtcttgagaatttatatgtggaaaagacgacatctacttcaaactgtatttttttcgtttttttttttttttggggaaagggggaaaaacggggttttgctttgtcccccaggctggagtgcaggggcccaatctcagctaactgcaacctccacctcccgggttaaaggaattctccctcacccccccgagtagctaaaaccacaggggcgtcccaccacacccggctaattttttggttttttaagaaaaaacggggtttattaaaaacggatcactcctgaccacgtgatccccccccctgggcctccaaaagggctggaattacaggcgtgaccccccacccccggcctgtttttccaaaaaggaaaccttggggtttttgggggcccaaggggaaaaaaaatgtctttt

SEQ ID NO: 11373 - DNA, 501 bp, Homo sapiens
ttcacagtcaccaggcctttccaaggactcatcccaaagcctgatgaagatgacgccaacagactcggggagaaggtgatcctgcgggagcaggtgaaggaactcttcaacgagaaatacggtgaggccctgggcctgaaccggccggtgctggtcccttataaactaatccgggacagcccagacgccgtggaggtcacgggtctgcctgatgacatccccttccggaaccccaacacgtaccgacatccaccggctggagaagatcctgaaggcccgagagccattgtccgcattggtcatcattaaccagctccaacccttttgcagaaatctgcaatgatgccaaggtgccagccaaagacagcagcattcccaagcgcaagagaaagcgggtctcggaaggaaattccgtctcctcttcctcctcgtcttcctcttcctcgtcctctaacccggattcagtggcatcggccaaccagatctcactcgtgcaatggc

SEQ ID NO: 11374 - DNA, 546 bp, Homo sapiens; identical to SEQ ID NO: 3036

SEQ ID NO: 11375 - DNA, 462 bp, Homo sapiens
gacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgaggggccaaatgagactgagggaagaaaaaaaatctctttttttctggaggctggcacctgattttgtatccccctgtagcagcattactgaaatacataggcttatatacaatgcttctttcctgtatattctcttgtctggct

SEQ ID NO: 11376 - DNA, 300 bp, Homo sapiens; identical to SEQ ID NO: 3037

SEQ ID NO: 11377 - DNA, 374 bp, Homo sapiens
gatcacctgaggctgaggccgggggtttgagaccagcctgaccaatatggagaaaccccgtctctactaaaaatacaaaattagccgggagtggtggcgcatgcctgtaattccagctactcgggaggctgaggcaggagagtcgcttgaacccgggaggcggaggttgcggtgagccgagatcgcgccattgcactctagcctgggcaacaagagggaaaactccgtctaaaaagaataagagggttacaagtagcctgaattttcctctcttcaaatagggacttctcaaagaaggtgaatctataatagtggtgtagattcagatataaggacacgtatttggcgtaaaggagaggcaaagttagaggaac

SEQ ID NO: 11378 - DNA, 191 bp, Homo sapiens
ccccggctgcagttggatttttaaattgcttttttttattgttgaggtttttttatctccaagggactctcccggcacttctaccttccagagttacttcagtgcataaagtttgaattattttgttcttgtgggcagaagtgggaatgatggaatatcctcacggaaaaggcagtgaagttgggagtact

SEQ ID NO: 11379 - DNA, 400 bp, Homo sapiens
gttgctgtcgccatgctgtagaatttttgtcttaaaaagaccacatacccagcacccatgaaataaaagattcatctgtaattgggattcaaagtgattaaattcctttgttcatactcataaatagcactaaagtgttataacattttcatttacctatttttagttccttcattttaacttaataaaaatcttggattgatattctttttttttttttttttaaaaaggggtttttttttttcccccagggggggaaaaaagggtttttttttgggttaatggaaacccccccccccgggttaaaccctttttttttgcttaacccgccaaggggggggaaattaaggccccccccccccaccccggtttttttttttttttttttaaaaaaaaaggg

SEQ ID NO: 11380 - DNA, 465 bp, Homo sapiens; identical to SEQ ID NO: 3044

SEQ ID NO: 11381 - DNA, 488 bp, Homo sapiens; identical to SEQ ID NO: 3046

SEQ ID NO: 11382 - DNA, 381 bp, Homo sapiens
cctccatgtgtccactcgctctttgcacatcggctcccagctgtctcctgaacagggaagctcaggcacttgagatgctaggagacagacacattcaaattgcactgctaccagacactgacagggatcaagtatgaggttctagcagatcctaagcaagctggaatagattctcttctccgaaagatttatgagatttactcagactttgccctcaagaatccattctgttgcttatagatgcctatcaagtgtgagctctttgaccataacctgaagctagctctggaggtggaagagaatgctggaacttctggacctgggtcatatgctgaacctgttatggacccccaaaatctgagagttcctgcaacaagaata

SEQ ID NO: 11383 - DNA, 107 bp, Homo sapiens; identical to SEQ ID NO: 3048

SEQ ID NO: 11384 - DNA, 574 bp, Homo sapiens
tcacgccagagtgcggctgggatccggcggccacctgcacctgcgtatctctcgggccgcccttcccgaggggctccccgaggcctcccgccttcaccgggctctgttccggctgtccccgacggcgtcaaggtcgtgggacgtgacacgacctctgcggcgtcagctcagccttgcaagaccccaggcgcccgcgctgcacctgcgactgtcgccgccgccgtcgcagtcggaccaactgctggcagaatcttcgtccgcacggccccagctggagttgcacttgcggccgcaagccgccagggggcgccgcagagcgcgtgcgcgcaacggggaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaat

SEQ ID NO: 11385 - DNA, 406 bp, Homo sapiens
cgttgctgtcgctaatgtggacatatctaaaataaatgaagttcttacagcagctgtgacacaagcctcactgcagtctataattcataagtttcttactgctggaccatctgctttcaacataacgtctctgatttctcaagctgctcagctctctacacaagcccagccatctaatcagtctccgatgtctttaacatctgatgcgtcatccccaagatcatatgtttctccaagaataagcacacctcaaactaacacagtccctatcaaacctttgatcagtactcctcctgtttcatcacagccaaaggttagtactccagttgttaagcaaggaccagtgtcacagtcagccacacagcagcctgtaactgctgacaagcagcaaggtcatgaacctgtc

SEQ ID NO: 11386 - DNA, 447 bp, Homo sapiens
attccgttgctgtcgcttgttgtaaaaccaggttccaagacactgccagcaccgtatgtaaaagtgtatctattagataacggagtctgcatagccaaaaagaaaacaaaagtggcaagaaaaacgctggaacccctttaccagcagctattatctttcgaagagagtccacaaggaaaagttttacagatcatcgtctggggagattatggccgcatggatcacaaatcttttatgggagtggcccagatacttttagatgaactagagctatccaatatggtgatcggatggttcaaacttttcccaccttcctccctagtagatccaaccttggcccctctgacaagaagagcttcccaatcatctctggaaagttcaactggaccttcttactctcgttcatagcagctgtaaaaaaattgttgtcacagcaaccagcgttac

SEQ ID NO: 11387 - DNA, 450 bp, Homo sapiens
gttgcggggccatggcggggaccgcgctcaagaggctgatggccgagtacaaacaattaacactgaatcctccggaaggaattgtagcaggccccatgaatgaagagaacttttttgaatgggaggcattgatcatgggcccagaagacacctgctttgagtttggtgtttttcctgccatcctgagtttcccacttgattacccgttaagtcccccaaagatgagatttacctgtgagatgtttcatcccaacatctaccctgatgggagagtctgcatttccatcctccacgcgccaggcgatgaccccatgggctacgagagcagcgcggagcggtggagtcctgtgcagagtgtggagaagatcctgctgtcggtggtgagcatgctggcagagcccaatgacgaaagtggagctaacgtggatgcgtccaaaatgtggcgcgatg

SEQ ID NO: 11388 - DNA, 389 bp, Homo sapiens
gtggcggttgctatcgcttcgcagaacctactcaggcagccagctgagaagagttgagggaaagtgctgctgctgggtctgcagacgcgatggataacgtgcagccgaaaataaaacatcgccccttctgcttcagtgtgaaaggccacgtgaagatgctgcggctggcactaactgtgacatctatgaccttttttatcatcgcacaagcccctgaaccatatattgttatcactggatttgaagtcaccgttatcttatttttcatacttttatatgtactcagacttgatcgattaatgaagtggttattttggcctttgcttgatattatcaactcactggtaacaacagtattcatgctcatcgtatctgtgttggcactgata

SEQ ID NO: 11389 - DNA, 615 bp, Homo sapiens
ctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaccgccttggccttcctgtctctgggggcccataataccaccctgacagagattctcaaaggcctcaagttcaacctcacggagacttctgaggcagaaattcaccagagcttccagcacctcctgcgcaccctcaatcagtccagcgatgagctgcagctgagtatgggaaatgccatgtttgtcaaagagcaactcagtctgctggacaggttcacggaggatgccaagaggctgtatggctccgaggcctttgccactgactttcaggactcagctgcagctaagaagctcatcaacgactacgtgaagaatggaactagggggaaaatcacagatctgatcaaggaccttgactcgcagacaatgatggtcctggtgaattacatcttctttaaa

SEQ ID NO: 11390 - DNA, 548 bp, Homo sapiens
gtaaaccaagtgtgtattcctgtgtatgaatttgtagaactgatttctgcttcaagagaagctgcacctttaattttataaggtcccctccacctgtaaccctataaatgtctgtaaataaaacactaaaatttgtagtgataggatcaatttgggaatatctgctgagagaccaaaaagttcatttttttaagtaccttggttaaagagtaaagattattcctcttattttttaaagaagaatgcactttaacaaacatagagctgcatgggcaattcaaacaaatctgtgaagtgcagtacccattcagaaatcacacttcctgaaaaccgttcaaaagcagagtccagacgggctgttgatctcactgcctgtaggttgaagctcagattctgatcaattttgagaggagcagggctgcttcaaaagagcaatgtgaatacagtcagaagcttcagactggtctgtaaaaatggcgggtcccgtatttaccactaactagcaaaactgacagaaaaactcacagagaaaaaatgtaagaatcctt

SEQ ID NO: 11391 - DNA, 520 bp, Homo sapiens; identical to SEQ ID NO: 3050

SEQ ID NO: 11392 - DNA, 523 bp, Homo sapiens; identical to SEQ ID NO: 3052

SEQ ID NO: 11393 - DNA, 543 bp, Homo sapiens; identical to SEQ ID NO: 3054

SEQ ID NO: 11394 - DNA, 598 bp, Homo sapiens
tggtgtgcctgggcctgagcagcatcgttggcgtctggtacctgctgaggaagcactggattgccaacaacctttttggcctggccttctcccttaatggagtagagctcctgcacctcaacaatgtcagcactggctgcatcctgctgggcggactcttcatctacgatgtcttctgggtatttggcaccaatgtgatggtgacagtggccaagtccttcgaggcaccaataaaattggtgtttccccaggatcttgctggagaaaggcctcgaagcaaacaactttgccatgctgggacttggagatgtcgtcattccagggatcttcattgccttgctgctgcgctttgacatcagcttgaagaagaatacccacacctacttctacaccagctttgcagcctacatcttcggcctgggccttaccatcttcatcatgcacatcttcaagcatgctcagcctgccctcctatacctggtccccgcctgcatcggttttcctgtcctggtggcgctggccaagggagaagtgacagagatgttcagttatgaggagtcaaatcctaaggatccagcggcagtgacagaatccaaag

SEQ ID NO: 11395 - DNA, 466 bp, Homo sapiens; identical to SEQ ID NO: 3055

SEQ ID NO: 11396 - DNA, 492 bp, Homo sapiens; identical to SEQ ID NO: 3056

SEQ ID NO: 11397 - DNA, 96 bp, Homo sapiens; identical to SEQ ID NO: 3057

SEQ ID NO: 11398 - DNA, 634 bp, Homo sapiens
  misc_feature 40, 41, 43, 634: n = A,T,C or G
ggcacgaggtcaccatgaagttcaatcccttcgttacctnngnccgcagtaaaaaccgcaaacgtcacttcaatgccccctcacacgtgcgcaggaagatcatgtcatccccgctctccaaggagctgcggcagaagtacaatgtccgctccatgcccatccgcaaggacgacgaggtccaggtagttcgaggacactacaaaggtcagcaaattggcaaggtagtccaggtgtacagaaagaaatatgtcatctacatcgagcgggtgcagcgtgagaaggccaacggcacaactgtccacgtgggcattcacccaagcaaggtggttatcaccaggctaaaactggacaaggatcggaaaaaaattcttgaacgcaaagccaagtctcgacaagttggaaaagagaaaggcaaatataaagaagaacttattgagaaaatgcaggaataaatagaacctgttgtgcaaccacggtttaaccggagattttgaggctagggtgtgtttctttcgaacttttcggaatgtctggaacatttcatttcctgttttgttacctgtgcctctgtaaatctacttttgcaattttaagtaataattttatgaataaaaatgggaaatgcttcctaaan

SEQ ID NO: 11399 - DNA, 572 bp, Homo sapiens; identical to SEQ ID NO: 3059

SEQ ID NO: 11400 - DNA, 697 bp, Homo sapiens
  misc_feature 27, 575, 657: n = A,T,C or G
ggcacgagggagaaccccctgcctgtncgtccccgggaaaaagaagaaccagtggttcgagagacaggtgaggtggtcgactgccacctcagtgacatgctgcagcagctgcacagtgtcaatgcctccaagccctcggagcgtgggctggtcaggcaagaggaggctgaggatcctgcctgcatccccatcttctgggtcagcaagtgggtggactattcggacaagtacggccttgggtatcagctctgtgataacagcgtgggggtgctcttcaatgactcaacacgcctcatcctctacaatgatggtgacagcctgcagtacatagagcgtgacggcactgagtcctacctcaccgtgagttcccatcccaactccttgatgaagaagatcaccctccttaaatatttccgcaattacatgagcgagcacttgctgaaggcaggtgccaacatcacgccgcgcgaaggtgatgagctcgcccggctgcctacctacggacctggttccgcacccgcagcgccatcatcctgcacctcagcaacggcagcgtgcagatcaacttctttcangatcacaccaagctcatcttgtgcccactgatggcagccgtgacctacatcgacgagaagccgggactttcgcacataccgnctgagtcttctggaggagtaccggttgctgcaaggagctg

SEQ ID NO: 11401 - DNA, 521 bp, Homo sapiens
ggcacgaggcgggacaggaggatccggtgcagcgggagattcaccaggactgggctaaccgggagtacattgagataatcaccagcagcatcaagaaaatcgcagactttctcaactcgttcgatatgtcttgtcgttcaagacttgcaacactaaacgagaaattgacagcccttgaacggagaatagagtacattgaagctcgggtgacaaaaggtgagacactcacctagaacagtgccgtgctgctgctgggaagttgctttacacaacacaggccacatgggaaaggccccagcagccttcagctccttcctttctccttaaagagcaacagggcttattcttgtttttcttttttcaaaagtgtggcctttgggctctgacatctggggtgtggtgtggtatgtgggaagaagttcaaaggaaccgttggaaacgacgttaggcattttaccttttcagtaacattttatacatctacttgtcaatgtatttgagacattcacagccaaaagcct

SEQ ID NO: 11402 - DNA, 492 bp, Homo sapiens
ggcacgagggcgtgttcggtggcggctctggccgctcaggcgcctgcggctgggtgagcgcacgcgaggcggcgaggcggcagcgtgtttctaggtcgtggcgtcgggcttccggagctttggcggcagctaggggaggatggcggagtcttcggataagctctatcgagtcgagtacgccaagagcgggcgcgcctcttgcaagaaatgcagcgagagcatccccaaggactcgctccggatggccatcatggtgcagtcgcccatgtttgatggaaaagtcccacactggtaccacttctcctgcttctggaaggtgggccactccatccggcaccctgacgttgaggtggatgggttctctgagcttcggtgggatgaccagcagaaagtcaagaagacagcggaagctggaggagtgacaggcaaaggccaggatggaattggtagcaaggcagagaagactctgggtgactttgcagcagagtatgc

SEQ ID NO: 11403 - DNA, 552 bp, Homo sapiens
ggcacgaggtcggtggggccggcggtcagtctgctgcagcggcagcaagacggtgcagtgaaggagagtgggcgtctggcggggtccgcagtttcagcagagccgctgcagccatggccccaatcaaggtgggagatgccatcccagcagtggaggtgtttgaaggggagccagggaacaaggtgaacctggcagagctgttcaagggcaagaagggtgtgctgtttggagttcctggggccttcacccctggatgttccaagacacacctgccagggtttgtggagcaggctgaggctctgaaggccaagggagtccaggtggtggcctgtctgagtgttaatgatgcctttgtgactggcgagtggggccgagcccacaaggcggaaggcaaggtgaggtgaggggcctgcaaggagtcaggaccaggtaggatattcttcttgtgacctttactttctctgcaggttcggctcctggctgatcccactggggcctttgggaaggagacagacttattactagatgattcgctggtgtccatctttggga

SEQ ID NO: 11404 - DNA, 134 bp, Homo sapiens
cccaccaatggaagcagctggcttcactgctcacgtgatgtatcctgaaccatacaggccaaatagagcgccggctatgcccctgtatcggattgccacacggctcacattgcatgcaagtttgctgagctgaa

SEQ ID NO: 11405 - DNA, 82 bp, Homo sapiens
caagctggggctcctaaaggttttatccacttggctgccaaggaaggcattggacaacagccagctttctcccaaaaagccc

SEQ ID NO: 11406 - DNA, 277 bp, Homo sapiens
actatagggctttttttttttcaaatgaatgacaactttatttttcttacacttttaaggctgatgaaaaaccttcatttcaattgaaaagtatgggaactgggtttactcattattattagttttctaaaacacaacttgaaaacatccagcatgcatgtttaatatcagtccaatgaattcaagaccaagtttacttgttacattcagcaaggctagattacagattatcatagtcatcatcatcatcatcggcatcatcatcatcttcacgttt

SEQ ID NO: 11407 - DNA, 64 bp, Homo sapiens
tatagggctttttttttttggctaagtggaaagaatttctttaccggggaaaggccctttggaa

SEQ ID NO: 11408 - DNA, 294 bp, Homo sapiens
agcggataacaatttcacacaggatgatgctaccagcaaatatgaatctgtcatgaaaacagagccaagcattgctgaatatacagttcgttcaaaggagaggatttgccactgcttttctaaggacgagaagcctgttgaagctattagggtttgttctgaagttttacagatggaacctgacaatgtgaatgccctgaaagatcgagcagaggcctatttgatagaggaaatgtatgatgaagctattcaggattatgaaactgctcaggaacacaatgaaaatgatcagca

SEQ ID NO: 11409 - DNA, 613 bp, Homo sapiens
caaaccctgttcttgggtgggtgtgggtataatactaagttgagatgatatcatttacgggggaaggcgctttgtgaagtaggccttatttctcttgtcctttcgtacagggaggaatttgaagtagatagaaaccgacctggattactccggtctgaactcagatcacgtaggactttaatcgttgaacaaacgaacctttaatagcggctgcaccatcgggatgtcctgatccaacatcgaggtcgtaaaccctattgttgatatggactctagaataggattgcgctgttatccctagggtaacttgttccgttggtcaagttattggatcaattgagtatagtagttcgctttgactggtgaagtcttagcatgcactgctcggaggttgggttctgctccgaggtcgccccaaccgaaatttttaatgcaggtttggtagtttaggacctgtgggttcgttaggtactgtttgcattaataaattaaagctccatagggtcttctcgtcttgctgtgttatgcccgcctcttcacgggcaggtcaatttcactggttaaaagtaagagacagctgaaccctcgtggggccattcatacaggtccctaa

SEQ ID NO: 11410 - DNA, 359 bp, Homo sapiens
gcttatggagggttcctctactattaggacttttcgcttcgaagcgaaggcttctcaaatcatgaaaattattaatattactgctgttagagaagtgaatgaccctacagatgataggatgtttcatgtggtgtatgcatcggggtagtccgagtaacgtcggggcattccggataggccgaaaaagtgttgtgggaaaaaagttagatttaccccgatgaatatgatagtgaaatggattttggcgtaggtttggtctagggtgtaccctgagaataggggaaatcagtgaatgaagcctcctatgatggcaaatacagctcctattgataggacatagtggaagtgagctacaacgt

SEQ ID NO: 11411 - DNA, 404 bp, Homo sapiens; identical to SEQ ID NO: 373

SEQ ID NO: 11412 - DNA, 494 bp, Homo sapiens; identical to SEQ ID NO: 3063

SEQ ID NO: 11413 - DNA, 341 bp, Homo sapiens; identical to SEQ ID NO: 3064

SEQ ID NO: 11414 - DNA, 460 bp, Homo sapiens; identical to SEQ ID NO: 376
  misc_feature 10, 13, 21, 23, 38, 41, 60, 67, 72, 75: n = A,T,C or G

SEQ ID NO: 11415 - DNA, 935 bp, Homo sapiens
  misc_feature 618, 627, 657, 670, 729, 782, 793, 808, 811, 837, 838, 839,840, 841, 842, 843, 844, 845, 846, 847, 848, 849, 857, 879,881, 892, 898, 904, 935: n = A,T,C or G
acgcggggtggggggggtcctggtctttggcttctcgactcggtcctgtttcgacagcgaacatgtcgcggcctgtcagaaataggaaggttgttgattactcacagtttcaggaatctgatgatgcagatgaagattatggaagagattcgggccctcccactaagaaaattcgatcatctccccgagaagctaaaaataagaggcgatctggaaagaattcacaggaagatagtgaggactcagaagacaaagatgtgaagaccaagaaggatgattctcactcagcagaggatagtgaagatgaaaaagaagatcataaaaatgtgcgccaacaacggcaggcggcatctaaagcagcttctaaacagagagagatgctcatggaagatgtgggcagtgaggaagaacaagaagaggaggatgaggcaccattccaggagaattccggcagcgatgaagatttcctaatggaagatgatgacgatagtgactatggcagttcgaaaaagaaaaacaaaaagatggttaagaagtccaaacctgaaagaaaagaaaagaaaatgcccaaacccagactaaaggctacagtgacgccaagtccagtgaaaggcaaanggaaaattnggtcgccccacagcttcaaaggcatcaaangggaaagaatccntctccaaaagaagaaagatgagggaaccggaaaaccccccagaaaaggaaaacatctanaagccccccaacccagaaatctggggataaaggggctgaaaaataaacccccntttggggaagntttaaaattatgaanggnctggggaaaaaatttttttaaaaaannnnnnnnnnnnnaaaaaaantttcctgcccgggggggcgccncnaaagggggaanttcaanaaaaangggggcggtttaaaaaggggtttccaccccn

SEQ ID NO: 11416 - DNA, 842 bp, Homo sapiens
  misc_feature 34, 40, 42, 44, 47, 48, 51, 54, 56, 58, 60, 67, 68, 69, 71,72, 75, 78, 82, 84, 91, 93, 95, 96, 99, 101, 102, 104, 105,106, 113, 119, 120, 123, 125, 126, 132, 136, 138, 172, 176,178, 180, 182, 186, 189, 190, 194, 195, 201, 204, 206: n = A,T,C or G
  misc_feature 207, 208, 210, 215, 223, 224, 231, 232, 242, 243, 245, 249,250, 251, 254, 256, 258, 259, 263, 265, 271, 276, 277, 279,283, 287, 290, 292, 293, 294, 300, 311, 312, 313, 316, 317,320, 332, 336, 337, 354, 365, 367, 368, 370, 373, 374: n = A,T,C or G
  misc_feature 376, 378, 388, 393, 401, 405, 407, 410, 418, 423, 429, 430,431, 432, 433, 437, 442, 448, 449, 459, 460, 467, 469, 474,475, 479, 483, 491, 493, 496, 500, 508, 511, 515, 517, 526,528, 529, 530, 533, 534, 535, 538, 539, 541, 542, 543: n = A,T,C or G
  misc_feature 546, 554, 555, 556, 558, 559, 568, 573, 574, 576, 579, 596,597, 600, 602, 605, 606, 607, 616, 625, 627, 630, 634, 639,644, 645, 650, 651, 652, 654, 657, 663, 664, 668, 670, 671,672, 680, 691, 707, 708, 711, 715, 717, 720, 722, 723: n = A,T,C or G
  misc_feature 726, 731, 740, 744, 745, 753, 755, 759, 760, 763, 767, 769,775, 777, 779, 781, 783, 788, 789, 799, 800, 803, 806, 813,815, 819, 826, 828, 833, 836, 841: n = A,T,C or G
tatgcctaaaaaagacacgggtcctatgcctcantcattncncnacnnggntcntntncntaaaaannncnnggntcntttncntaaaaangncnnggntnntnnncctaaancttccnnggncnnggttcntttncntaaaaaggacccggggcttttgctaacggtatcngctnantnanaggnggnnatanngttatncanannntnttggnataactcnngatagannatgttagcannangtcnnnatnangnntggnancgttantggcnncntagnttgncgntnnngcatangcttctcgccnnngannttntgctttcactgntttnngacgctctgctttagangttgtggcaantnncntanngntnttatttgacnttacnattgctgnctcncnatnttggatanctccnctctgnnnnncttnacttnttctcnngtcttgtctnnttagctngnttttnnttgntccngctttttntntcntttngagggaantanggcntntggtctttntnnnctnnnggnntnnnaancctttagnnntnnctatttaantttanntntgnttagggtctggtattcnngtntnctnnncggctttgntgtgcttgnangtntgcnactcntaatnnctggnnncngtntttcanntctncnnnatccgcgntttgctgtctntattaatcccctcgtnntancttntncantnnttntgttngcgtcatantacnngtttatangnttgnntcnatgntntatagntnantntntggtnncctagttctnngcnggngattctnanggtnttagctncntatangantgtgnt

SEQ ID NO: 11417 - DNA, 650 bp, Homo sapiens
tcccgccgcgccagttcgcctccgcaaagcccgtccctctcttccgcaggcaccatgttcctgactgcgctcctctggcgcggccgcattcccggccgtcagtggatcgggaagcaccggcggccgcggttcgtgtcgttgcgcgccaagcagaacatgatccgccgcctggagatcgaggcggagaaccattactggctgagcatgccctacatgacccgggagcaggagcgcggccacgccgcggtgcgcaggagggaggccttcgaggccataaaggcggccgccacttccaagttccccccgcatagattcattgcggaccagctcgaccatctcaatgtcaccaagaaatggtcctaatcctgagtcgtcacccttggattttatggatcacggagctgaccatctttacctggtcctggaactgaaaaactgtagcttgtgtgaaaatgagcctttggaccagtctttattaaaacaaacaaacatgagtagtctgcatatcgaatatctagagctctaaaccccccaatacttaaaagtctaattgctgtcctgtggtttcattagtctgataggaagatagggatttcctcagtcacagatgatattttgaaggaaagctgcaataaagccacaatgatttg

SEQ ID NO: 11418 - DNA, 555 bp, Homo sapiens; identical to SEQ ID NO: 3066

SEQ ID NO: 11419 - DNA, 548 bp, Homo sapiens
ttgtctgtcctcggaagaactccccctgcttctttctctaaaggctgtcttcaggccgggcacagtgggaggatcgcttgagcccagaaggccgcagtgaggtgagatcgcgccattgcactgcagcccccggcggcagagccggagccccgtctcgaaacaaacaaacaaaaaccaaccaaccaaccaaccaaccaacaaacaaacacagacaaagaaagaaagagcccaggcaacctagtgaaaacctgttcgggctggggcgtacctgtaccccagctgttccggaggctgaggccaggaggatgggtggacgctgggaggtggatgctgcagtgagcagtgattgcaccactgcactccagcctgggtgacagagccagaccccgtcccaaataaataaacataaaaataaaggaaccagtttgtagaaagcgggagagggtcccattgaacttcaagccttcgagcaacagctgtggctggacaggttggaccagcaggctggagcagtcgccatcttggcagggatcattgaccctgatcta

SEQ ID NO: 11420 - DNA, 565 bp, Homo sapiens; identical to SEQ ID NO: 3068

SEQ ID NO: 11421 - DNA, 70 bp, Homo sapiens
ccctgggacaccctgagcaccacccagaagaagagactgaaccacacgtaccagatgggctgctagtgca

SEQ ID NO: 11422 - DNA, 465 bp, Homo sapiens
ccctacagccgcgtggtgcacacctaccgcctccccagctgtggctgccaccccaagcactcctggggcgccctgtgccgcaagctgttccttggggagctcatctacccctggaggcagagaggggacaagcaggactgagggaactgctggctcgcctggcaccaccacacggccacagccagccatctgctctgccagggtggcaccagctcagctggcgcatgtcctgtgctttgtggacgctgctgtgtgctactgaacacggcaggccctgctatcacaccttgggcttggaggacattgggagtgagcagatgtgggggtggccagccaagctggccgcactccatcactggcactgactgccttgagacccgcttcccacctgctgcggtcaccatggtggcgagcacagcaaccccaggtgtccagagcactgccccatgcccaccctgtgtaccc

SEQ ID NO: 11423 - DNA, 713 bp, Homo sapiens
  misc_feature 510, 547, 655, 668, 710, 712: n = A,T,C or G
cacttccctcgttattttctctcattttttgatgagaggaaaatttgaaacattattcttgttgttgttggtaatagcataatgacagtgggaggggtacaaggggataagaaaaatgtcatgatttttttccggtcctgccacatgtaacacttactctgttacctaaattttatagttagatcatatccaatctacttattaaactgtgttctatttaccagtggagtttttctgcagtggttgcgtttcactgtaaggataatggagttcctctcctctgctttcctcagaggatggtcctttaacatagccagaaacaagccctgtggtttgaaggtgagctgtgaggatgggactaattgatatgcaccagtttacaaagacagtcttatcatccgagaatacaccatctttttctctggataattatttcttacatcatgcttgattcctacattttgttgggtctcaacattggctcacgaatgctggtaatatttattctgnattgataaaaagtctgtcttgccactacaagtaaatnccccatttaatattttcttctttagcatagcactgtcattttttgtgaaaatggttatgtttatttattacaatactgagtcatatataaaattttcaaataaaagcngaaactttcttanccttaaaaaaaaaaaaaaaaaaaaactcgagcctttagactntng

SEQ ID NO: 11424 - DNA, 464 bp, Homo sapiens
gctgtcgatgacggcctccgtgctgcgaagtatctcgctagccctgcgcccgactagcgggcttctgggaacttggcagacgcagcttagagagactcaccagcgagcgtcattgttgtctttctgggaactcattcccatgagatcagaacctcttcgaaaaaagaagaaggtagatcctaaagaagaccaagaagcaaaggagcgcttgaaaaggaagatccgaaaactggaaaaggctactcaagagctaattcctattgaagattttattacccctctaaagttcttggataaagcacgagagcggcctcaggtggagctcacctttgaggagactgacaggagagctctgcttctgaagaagtggtccttgtacaagcagcaagagcgtaagatggagagggacaccatcaaggctatgctagaagcccatcaggaagctctggaggaactgcaactgg

SEQ ID NO: 11425 - DNA, 539 bp, Homo sapiens
tccgttgctgtcggttttttctgctttctttgaaatgttccttacagaataactacatgaatgtaatcacatgcatttaaaatagtctagagaatatagtgtgaaactataatggtatttttttagatgaggtttctggtggcatattactaaaattttaaactccttgatcttatgctgttaaccaagaagatggggatttgtgttactttagacactgctgggtgccatggtaaattgggatgttattgtaaattgtagctctcacagctgcgtattgcttacaaactcggaaggatagtctcatatcagtaaacatttttatgaacgtagttgaacttttttgtaaattaatgtgctggaaagaataccaagagggccctaaaaaagtctaaaaggattaaaatttacttatgtaattattggtattttaaaatatttggtagtcacttaaaatgcataatgacagacaatagggtgtcataatatggtttattaatcttttttcattttccactagatgtggcaactacatagtt

SEQ ID NO: 11426 - DNA, 259 bp, Homo sapiens
gtcgctccgctcagtttccggtgcggcgaacaccaaagtccgggaacttaagcattttcggtttctagggttgttacgaagctgcaggagcgagatggaggtggacgcaccgggtgttgatggtcgagatggtctccgggagcggcgaggctttagcgagggagggaggcagaacttcgatgtgaggcctcagtctggggcaaatgggcttcccaaacactcctactggttggacctctggcttttcatccttttcgat

SEQ ID NO: 11427 - DNA, 605 bp, Homo sapiens
ttccgttgctgtcggcgggtttcggttggaggactcgttggggaggtggcctgcgcttgtagagactgcatccccgagacgatggcggagggagataatcgcagcaccaacctgctggctgcagagactgcaagtctggaagaacagctgcaaggatggggagaagtgatgctgatggctgataaagtcctccgatgggaaagagcctggtttccacctgccatcatgggtgtggtttctttggtgtttctgattatctactatctagatccatctgttctgtccggcgtttcctgttttgttatgtttttgtgcttggctgactaccttgttcccattctagcgcctagaatttttggctccaataaatggaccactgaacaacagcaaagattccatgaaatttgcagcaatctagtaaaaactcgacgcagagctgtgggttggtggaaacgcctcttcacactaaaggaagaaaaacctaagatgtacttcatgaccatgatcgtttcccttgctgcggttgcttgggtgggacaacaagtccacaacctgcttctcacctacctgatagtgacttccttactattgcttcctggactaaa

SEQ ID NO: 11428 - DNA, 572 bp, Homo sapiens
gtcgggtacttctcctagttgcagtcaggcttcatacgctattgtcctgcccgtaagttcccgttttgtgtgtggtgagtggaaactccatgttcttcgttggagacctctggtcctcccttcccttctttgtgccgtcgtctctgcggccagccctaatctccttctcgtggcttctccgtctctgaccccaaataggccttaagggcgtgggagaaatgagtttctggagctggaaaagccactgccttctgcacgggcctgagaagcccttggctggtgtaaatgatgacttcacttttttccccatcagatcgacaatgctgacgtcttatattttgccagttagttctgatacatcggcctcaaaaggcccggccttgttcgtttctgaccgtgggaagatggcggttaacgccctttatttgttggttcacaggttagagcagccagcgggtacagaatggattttggaagagggagtcaccactggacctccaaggaagccacgtgcagacatctacaaccttcgatctcctgacgagtaagtctttgtctcctatgggtctact

SEQ ID NO: 11429 - DNA, 473 bp, Homo sapiens
aagggcagctgactaagagccctctggcacaaatggaagaagaaagaagggagcatgtagctaaaatgaaaaagatggagatggagatggagcaggtgtttgagatgaaggtcaaagaaaaagttcaaaaactgaaggactctgaagctgagctccagcggcgccatgagcaaatgaaaaagaatttggaagcacagcacaaagaattggaggaaaaacgtcgtcagttcgaggatgagaaagcaaactgggaagctcaacaacgtattttagaacaacagaactcttcaagaaccttggaaaagaacaagaagaaagggaagatcttttaaactctctattgaccaccagttaacgtattagttgccaatatgccagcttggacatcagtgtttgttggatccgtttgaccaatttgcaccagttttatccataatgatggatttaacagcatgacaaaaattatttttttt

SEQ ID NO: 11430 - DNA, 456 bp, Homo sapiens; identical to SEQ ID NO: 2710

SEQ ID NO: 11431 - DNA, 552 bp, Homo sapiens
ggcacgaggaaaaagaagactcatttggaaatgaagctgtccctttccaagcagtctctggtgcttttcttctctcaaaatggatccgataaatatttgaatagagcagattgtagaatgtcgtgctgtcaccagaaagctgctgttttgggttctgcattgagccaaatatgtagaggacctaccaagcccactgagggactaggttttcatgtctctggtcatacctagaatgttctgagccgtctgagggccttcatgccggcagcagctagcaaagccagaaagcaagtctaacaggatctaagatgaccatcaggagaaggagtttgagactgtgtatgcaacccccaatagacccccttttactctgatctggagaatgtatctggcttcatattttcaagtcacatgtctctcagacccctggattcagaacccaaggccacaaatcataggcatgaagcactttcttaagactgacctaacgctggattatttcccgtccaatgcctgcatgctgcttgaattgctccacccacacctccatga

SEQ ID NO: 11432 - DNA, 622 bp, Homo sapiens; identical to SEQ ID NO: 3075
  misc_feature 255, 602, 615: n = A,T,C or G

SEQ ID NO: 11433 - DNA, 542 bp, Homo sapiens
cgacaaatgcacctcacagtgttaaattcttgctcaaaatcaaacatccccaagggacaagtggaagattcaaactccttatgggctggagttcaagaccagcctggtcaacatggtgaaactcccctctactaaaaatacataaattagctgggcgtggtggcatgcacctgtaatcccagctacttgggaggccgaggcaggcagatcacctgaggtcaggagttcgagaccagcctggccaacatggttgaaaccccgtctctactaaaaatacaaaaattagccgggtgtggtggtgggcgcctataatcccagctattcgggaggctgaggcaggagattgcttgaacccaggagagggagtttgcagtgagccgagatcgtgccactgcactccagcctgggggacagagcacagtggttcatgcctgtaatcccagcactttgggaggcagaggagggcggatcacctgaggtcgggagctcgagaccagcctgaccaacatggagaaaccccatctctactaaaaatacaaaat

SEQ ID NO: 11434 - DNA, 376 bp, Homo sapiens
tagtaggacgtagggtcttattttgttttcaaacccacatcctcagagcgcagatacatgcagaggcttctgccaggataccacggggccttagtgggaacaggtggagaccatcacttacctttcctgctgctgaggtagggattgcggggtcagaacccactcacttttgcctgttaaagttgccctcctgacgctggcagctctgccttggtcactggggatgcggctcgttgctcagccaccagtggccttgcggtattgtccaccatccactagagtgggatgaagtccacagtgtgggtatacatctcagatgcccatctacccactggggacttcaatgccagctgcatttggtttggttttcttaact

SEQ ID NO: 11435 - DNA, 624 bp, Homo sapiens
acgctagagcatgaggggggctacctccccttcgaggccgacatcagcaacctggtccaggtggggcccctgccctcccggcttcgaatcactatcgccatcaacaacacactcacccccaccaccctgccaccagggaccatccaatacctgactgacacctccaagtatcccaagggttactttgtccagaacacatattttgactttttcaactacgctggactgcagcggtctgtacttctgtacacgacacccaccacctacatcgatgacatcaccgtcaccaccagcgtggagcaagacagtgggctggtgaattaccagatctctgtcaagggcagtaacctgttcaagttggaagtgcgtcttttggatgcagaaaacaaagtcgtggcgaatgggactgggacccagggccaacttaaggtgccaggtgtcagcctctggtggccgtacctgatgcacgaacgccctgcctatctgtattcattggaggtgcagctgactgcacagacgtcactggggcctgtgtctgacttctacacactccctgtggggatccgcactgtggctgtcaccaagagccagttcctcatcaatgggaaacctttctatttccac

SEQ ID NO: 11436 - DNA, 521 bp, Homo sapiens; identical to SEQ ID NO: 3077

SEQ ID NO: 11437 - DNA, 411 bp, Homo sapiens
  misc_feature 340, 350: n = A,T,C or G
cgttgctgtcgattattttagctaaattcagggagattgcgtggggcaggaaagcatgcattgaaaaatttctaaccacggttatttaagcataatctgaaaacatctagcccaaaggtaagttgctattttcatcacagttgcctatgcccagggaataagatgtattctttataattgaattggtttttcccacgtctaactggaaacaaaacagaaggggcgtcataaatttgaataagcagaacatactgttctcaacatactgtaatcaaaaggaggaatttcagtgggtctctgtgtgtgtatgagagagagagtgtgtgtttgtgtgtttcanggtcaaaacnggtttttttgtttttggtgctgggcgggtgggcctgcttccggctgggggggggcttgccg

SEQ ID NO: 11438 - DNA, 551 bp, Homo sapiens
atttgaccaaatggaagaatcatgttagttctgacctcaatactatagtaacttttaggcgtgggtgtagaagtttataggtttctattgacagttattgtaaattagcatttactgtggtacaaattctttataactgacttagtcatttgccgcttagcagtttatatactgaaatgaaaacatcttgtggggaaaagtgactttagattatgaactcaattcaaatgaactctatttaaaatggggtcctattttggacaaaggaaattaagaatgtaaaagtcagaacagtcttgaggtaaaaagtgtgctttggcttaaaagggatacagtatattaattacatcttttattattattgtttatttcttagaatcatttctggctttctcaaaacaaaataatattaatgagtacttctatttgctgcatttttcttattacagcctttgaaacagctggtaattataagtcattttccattttttaaaacataattttataaagaattctcttatctcgactatgtagaataccacctactggac

SEQ ID NO: 11439 - DNA, 513 bp, Homo sapiens; identical to SEQ ID NO: 3078

SEQ ID NO: 11440 - DNA, 482 bp, Homo sapiens
tcattttggagggaagcggcttagccttctctataagggtagtgtccatggattccgtaatggagttttgcttgacagatgttgtaatcaagggcctactctaacagtgatttatagtgaagatcatattattggagcatatgcagaagagagttaccaggaaggaaagtatgcttccatcatcctttttgcacttcaagatactaaaatttcagaatggaaactaggactatgtacaccagaaacactgttttgttgtgatgttacaaaatataactccccaactaatttccagatagatggaagaaatagaaaagtgattatggacttaaagacaatggaaaatcttggacttgctcaaaattgtactatctctattcaggattatgaagtttttcgatgcgaagattcactggatgaaagaaagataaaaggggtcattgagctcaggaagagcttactgtctgccttgagaacttatg

SEQ ID NO: 11441 - DNA, 404 bp, Homo sapiens
cgttgctgtcggtatattatgagaaagtggggtttcgtggagttgaagaaaagaaatcattagaaattctcctaaaagatgaccgtctggatactgagaaactttgtacttttagtcagaggttccctctcccgtccatgtaccgtgcattggtatggaaggtgcttctaggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggag

SEQ ID NO: 11442 - DNA, 541 bp, Homo sapiens
ttccgttgctgtcggtacactctgtgattgtacaattttaaaatctcctaatgatgatgcatttctcagaatgtatcccctttgctaagcaatgcatgactgcaatcctaattctcacatgttttggggaaaaaattttaattttgaaaaaatttaggaaagttcctaccaaatatacatgtataaagtttattaaaagtcataatgacccaggaatagctaatgacacagaagtagatcaaaatagaacacaatagagaacttcaaaataaaacaggtgtgagaattgtgtgtgtgaaaaagctgggttcaaataagttggtttgttagacattcatatgcctactcatcagccatttcgttctcccttccttgctgacaaagccccattttttttttctttttttttggcctaaaactctgtatggctgccttgtgctataaaatagggtgcttccctagcctaaagagggtgagtgttgattagattctgtgccaatcatggtaattggcttacttgatcatttgatggaatctaggc

SEQ ID NO: 11443 - DNA, 506 bp, Homo sapiens
ccagctgggcccctcccaggcactgccaggaagccccagctgcccctggcgggtgtggtggaaatggcaggagggtgcaggtactcttggggccccagcggtgggagtgcaaaagacccaacgccaacacctggtgccttctgcagccagcgcccacccatccgtgcccggacccttgggaatgcccgcggctccagaggaaaaagcccagggacggggcctccgttgcggggggtcggctgcttcttgggaactttgtcgtttccggcgctggctggctggctggctgtaaagcactgaagccccccggccgccaacccctgaaagcagaacctggcctccctggccacagcagccttacccaccgctctacgtgtcccgggcacttcccgcagccttcccgtccctttctcatcggccttgtagttgtacagtgctgttggtttgaaaaggtgatgtgtggggagtgcggctcatcactgagtagagaggtagaatttctattt

SEQ ID NO: 11444 - DNA, 399 bp, Homo sapiens
ggcacgagattgcttttcatagtgcagtaagtttggacccaattaaatcctttgaagctcctgcaaccatcaattctgcatctcttcatcctgagaaagaatttcttgttgcaggcggtgaagattttaaactttataagtatgattataatagtggagaagaattagaatcctacaagggacactttggtcctattcactgtgtgagatttagtcctgatggagaactctatgccagtggttcagaagatggaacattgagactatggcaaactgtggtaggaaaaacgtatggcctttggaaatgtgtgcttcctgaagaagatagtggtgagctggcaaagccatttttgaattgctgattactttggctttaatcagtggtcacctagaaaaagc

SEQ ID NO: 11445 - DNA, 89 bp, Homo sapiens
agcggttgacgaggtgcagcgcgagagggtgtcagccaagaacgccctggagtcctacgccttcaacatgaagagcgccgtggaggatg

SEQ ID NO: 11446 - DNA, 300 bp, Homo sapiens
ctcacacctacccctaccgtccagcctggcctcttccctgaatcagcttcaagatggcaccagctctttgggcctaggatactgccgggccccccaagggggtccccagcaaccaggcctggcctcctggtgtctgcggtcacagtggcccctgggcaggggcacccaggctgaccctgaggtgctgctgctgggtctgtcttggctctggggtgtgctgggagggtcaccaggtcccttttccttcctgtgccctctgaaagctaagtgtctgtgtggctgtggagctcgagggtctgt

SEQ ID NO: 11447 - DNA, 502 bp, Homo sapiens
cgcgagatcctctccattttgggcttgccccaccgcccgcgcccgcacctccagggcaagcacaactcggcacccatgttcatgctggacctgtacaacgccatggcggtggaggagggcggcgggcccggcggccagggcttctcctacccctacaaggccgtcttcagtacccagggcccccctctggccagcctgcaagatagccatttcctcaccgacgccgacatggtcatgagcttcgtcaacctcgtggaacatgacaaggaattcttccacccacgctaccaccatcgagagttccggtttgatctttccaagatcccagaaggggaagctgtcacggcagccgaattccggatctacaaggactacatccgggaacgcttcgacaatgagacgttccggatcagcgtttatcaggtgctccaggagcacttgggcagggaatcggatctcttcctgctcgacagccgtaccctctgtgcctcggaggagggct

SEQ ID NO: 11448 - DNA, 140 bp, Homo sapiens
ggcacgagggaaagcagagagcttgaagaaatgtctctctgtcatggaagccaaagtgaaggctcagactgctccaaacaaggatgtgcagagggagatcgctgaccttggagaggccctggccactgcagtcatccccc

SEQ ID NO: 11449 - DNA, 577 bp, Homo sapiens
agatgtgtatgagttcagagacaagctgtgtggaccatatgaaaaatttatatgtgagcaggattatcaaaattttttgagactcctcacagaaactgaagactggctgtatgaagaaggagaggaccaagctaaacaagcatatgttgacaagttggaagaattaatgaaaattggcactccagttaaagttcggtttcaggaagctgaagaacggccaaaaatgtttgaagaactaggacagaggctgcagcattatgccaagatagcagctgacttcagaaataaggatgagaaatacaaccatattgatgagtctgaaatgaaaaaagtggagaagtctgttaatgaagtgatggaatggatgaataatgtcatgaatgctcaggctaaaaagagtcttgatcaggatccagttgtacgtgctcaggaaattaaaacaaaaatcaaggaattgaacaacacatgtgaacccgttgtaacacaaccgaaaccaaaaattgaatcacccaaactggaaagaactccaaatggcccaaatattgataaaaaggaagaagatttagaagacaaaaac

SEQ ID NO: 11450 - DNA, 297 bp, Homo sapiens
cgggttctgacaagatggccgggctgccccgcaggatcatcaaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccacaagaatacccaatggcagcccctaaagtacgtttcatgaccaaaatttatcatcctcatgtagacaagttgggaagaatatgtttagatattttgaaagataaga

SEQ ID NO: 11451 - DNA, 549 bp, Homo sapiens; identical to SEQ ID NO: 3086

SEQ ID NO: 11452 - DNA, 89 bp, Homo sapiens
ttttccttttccaaattttttttcccctcctaaaaaactccaaaagggcccttaaaagccttttttttaaaaaagggattttttttttt

SEQ ID NO: 11453 - DNA, 559 bp, Homo sapiens
ggcacgagcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccagggccgtggtggagaagcgcctagcagcctgcgtcaacctcatccctcagattacatccatctatgagtggaaagggaagatcgaggaagacagtgaggtgctgatgatgattaaaacccaaagttccttggtcccagctttgacagattttgttcgttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatccccgcgatacttcaacgccttctgacttccaggtgatgactgggcccccaataaatcccgtctttgggtctc

SEQ ID NO: 11454 - DNA, 326 bp, Homo sapiens
ggcttagcggataacaatttcacacaggatggattggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgcg

SEQ ID NO: 11455 - DNA, 453 bp, Homo sapiens
ccgttgctgtcggccggcggaagacctggctccgtcatggcctctgccctgaggccaccccgtgtccccaagcctaagggtgtcctgccttcacactactatgagagctttctagagaagaaggggccctgtgaccgggattacaagaagttctgggcaggcctgcagggtctcaccatttatttctacaatagcaatcgggacttccagcacgtggagaagctcaacttgggagcatttgagaaactcacagatgagattccctggggaagctcacgtgaccctggcacccacttcagcctgattctccggaatcaggagatcaagttcaaggtagagaccttggagtgtcgggaaatgtggaaaggcttcatcttaacggtggtggagctccgtgtcccgaccgacttgaccctgctttctgggcacctatacatgatgtctgaagtcttg

SEQ ID NO: 11456 - DNA, 103 bp, Homo sapiens
ttccgttgctgtcggctcaaaataccaatgcagtttctgcattctgggttttgtttttccttttttttttttaaattttgcctttggcccccaaggtggaagg

SEQ ID NO: 11457 - DNA, 496 bp, Homo sapiens
gtggaaaaggtggagcgattagaatgggtatattcagttctcgaggagaaaagatccttatggcagatgctgatggagccacaaagtttccagatgttgagaaattagaaaaggggctaaatgatctacagccttggcctaatcaaatggctatagcatgtggatctcgagctcatttagaaaaagaatcaattgctcagcgttcttacttccgtactcttctcatgtatgggttccactttctggtgtggttcctttgtgtcaaaggaatcagggacacacagtgtgggttcaaattatttactcgagaagcagcttcacggacgttttcatctctacacgttgaacgatgggatttgatgtagaactactgtacatagcacagttctttaaaattccaatagcagaaattgctgtcaactggacagaaattgaaggttctaaattagttccattctggagctggctacaaatgggtaaagacctactttttata

SEQ ID NO: 11458 - DNA, 565 bp, Homo sapiens
cgttgctgtcggggcctggctcctggcccagatggcacctggcctcttgagtctgctgggggaccccaaagttggtggtcccatagcctgccctcctgggtctccacctcatgcctggacaggacgctgtggcctgtccgggccttggccagccctgcagctgcacccccgatcctcatccctcaccccattccctgccagcatcctaaggctcctggcgggcatcctctctgctcaaaattattgacctgtctcccggccacacctgctgtgccctctcagccaggccatcatcaccccctgttcattatgtcaggcctcatgggagcctggccttctccagaagctggccccggcgtcctcccaagctggaccacgtaggccccagatcacacctgggggtccagatgtaggggtcccgtgtgcacgcccaatcagaccgagcacttgtgacactaccccaacacctctcccagggctgaatgaggaacgcgccactggacacatgaggaagaggctgccctgggagctactgatgctgtgacctcacctctctggctttggg

SEQ ID NO: 11459 - DNA, 452 bp, Homo sapiens
ccgttgctgtcgcatggctcctgtgaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaacc

SEQ ID NO: 11460 - DNA, 392 bp, Homo sapiens
  misc_feature 2, 3, 4, 5, 6, 7, 8, 9, 10, 13, 21: n = A,T,C or G
gnnnnnnnnnccnttggaagncccttcctctgaagggccgatgtatataactatctattcgatgatgaagataccccaccaaacccaaaaaaagagatctctcgaggatccgaattccagatctatgaatcgtagatactgaaaaaccccgcaagttcacttcaactgtgcatcgtgcaccatctcaatttctttcatttatacatcgttttgccttcttttatgtaactatactcctctaagtttcaatcttggccatgtaacctctgatctatagaattttttaaatgactagaattaatgcccatcttttttttggacctaaattcttcatgaaaatatattacgagggcttattcagaagctttggacttcttcgccagaggtttggg

SEQ ID NO: 11461 - DNA, 356 bp, Homo sapiens; identical to SEQ ID NO: 3087

SEQ ID NO: 11462 - DNA, 169 bp, Homo sapiens
ttcttttttttctacaacttgaattttttttaacattaaaaaattctggccaggcatggtagctcatgccctataatcctagcattttgggaggccaaggtgggaggatcacttgaggctaggagtttgagaccagcctaggcaacacagtgagaccctgtctctatgg

SEQ ID NO: 11463 - DNA, 568 bp, Homo sapiens; identical to SEQ ID NO: 3088

SEQ ID NO: 11464 - DNA, 494 bp, Homo sapiens; identical to SEQ ID NO: 3089

SEQ ID NO: 11465 - DNA, 463 bp, Homo sapiens; identical to SEQ ID NO: 344

SEQ ID NO: 11466 - DNA, 677 bp, Homo sapiens
gctgtcggtcagccatggccaccgctctcgcgctacgtagcttgtaccgagcgcgaccctcgctgcgctgtccgcccgttgagcttccctgggccccgcggcgagggcatcggctctcgccggcggatgacgagctgtatcagcggacgcgcatctctctgctgcaacgcgaggccgctcaggcaatgtacatcgacagctacaacagccgcggcttcatgataaacggaaaccgcgtgctcggcccctgcgctctgctcccgcactcggtggtgcagtggaacgtgggatcccaccaggacatcaccgaagacagcttttccctcttctggttgctggagccccggatagagatcgtggtggtggggactggagaccggaccgagaggctgcagtcccaggtgcttcaagccatgaggcagcggggcattgctgtggaagtgcaggacacgcccaatgcctgtgccaccttcaacttcctgtgtcatgaaggccgagtaactggagctgctctcatccctccaccaggagggacttcacttacatctttgggccaagctgctcaatgaaccgccaggaactgacctgctgactgcactctgccaggcttcccaatgctttcactcttatctaccctttggcacttatcttgcttatcaacataataatttatacac

SEQ ID NO: 11467 - DNA, 476 bp, Homo sapiens
aaacttcctcctggaggaatacctggcattgacctctcagatcccaaacaactggcagaatttgctagaatgaagccaagaaaaattaaagaagatgatgctccaagaacaatagcttgccctcataaaggctgcacaaagatgttcagggataactcggccatgagaaaacatctgcacacccacggtcccagagtccacgtctgtgcagaatgtggcaaagcttttgttgagagttcaaaactaaaacgacaccaactggttcatactggagagaagccctttcagtgcacgttcgaaggctgtgggaaacgcttttcactggacttcaatttgcgcacacatgtgcgaatccataccggagacaggccctatgtgtgccccttcgatggttgtaataagaagtttgctcagtcaactaacctgaaatctcacatcttaacacatgctaaggccaaaaacaaccagtgaaaaga

SEQ ID NO: 11468 - DNA, 548 bp, Homo sapiens
gacaagcttcgtttcaggggtctgccgttccatcctggttcagagaaggccgagcgtggctttctctagccttgtcactgtctccctgcctgtcaatcaccacctttcctccagaggaggaaaattatctcccctgcaaagcccggttctacacagatttcacaaattgtgctaagaaccgtccgtgttctcagaaagcccagtgtttttgcaaagaatgaaaagggaccccatatgtagcaaaaatcacggctgggggagagccgggttcattccctgtcctcattggtcgtccctatgaattgtacgtttcagagaaattttttttcctatgtgcaacacgaagcttccagaaccataaaatatcccgtcgataaggaaagaaaatgtcgttgttgttgtttttctggaaactgcttgaaatcttgctgtactatagagctcagaaggacacagcccgtcctcccctgcctgcctgattccatggctgttgtgctgattccaatgctttcacgttggttcctggcgtgggaactgctctcctttgc

SEQ ID NO: 11469 - DNA, 461 bp, Homo sapiens
gaagttgatttcaagccattcggaaccttacttcatacctactcagttctcagtccaacaggaggagaaaactttacctttcagatatataaggctgacatgacatgtagaggctttcgagaatatcatgaaaggcttcagacctttttgatgtggtttattgaaactgctagctttattgacgtggatgatgaaagatggcactactttctagtatttgagaagtataataaggatggagctacgctctttgcgaccgtaggctacatgacagtctataattactatgtgtacccagacaaaacccggccacgtgtaagtcagatgctgattttgactccatttcaaggtcaaggccatggtgctcaacttcttgaaacagttcatagatactacactgaatttcctacagttcttgatattacagcggaagatccatccaaaagctatgtgaaattacg

SEQ ID NO: 11470 - DNA, 363 bp, Homo sapiens
tttgcctaccgggttaaagcagttttcctgcctaagcctttcaagtagttgggattacaggcacttgtaaccaccccgggttaatttttgttttttaagttaaaacggggtttaaccatgtggggcaggctagtttcaaactcctgacctaaagtgatccgcctgccttggcctcccacagggttggaattacaggtgtgagccaccgggcctggcctacttttgaaatttgggatgaggaaacaaaaaataaattgtttaaaaccacttaaaaaaattcatggaaaatacttatttaaaaaaaagtagttaatataaccttattttttttatctgctaacccctttttttaaaatgcactta

SEQ ID NO: 11471 - DNA, 150 bp, Homo sapiens
tgcaaaccatcgtccatattgcaagcaatcagatttatttatttattttttgaggcaggagaatggcgtgaacccgggaggcaaagcttgcagtgagccaagatcgcaccactgcactccagcctgggtgacagagcgagactctgtctc

SEQ ID NO: 11472 - DNA, 414 bp, Homo sapiens
ggagcatggctgggagccgtgaggtggtggccatggactgcgagatggtggggctggggccccaccgggagagtggcctggctcgttgcagcctcgtgaacgtccacggtgctgtgctgtacgacaagttcatccggcctgagggagagatcaccgattacagaacccgggtcagcggggtcacccctcagcacatggtgggggccacaccatttgccgtggccaggctagagatcctgcagctcctgaaaggcaagctggtggtgggtcatgacctgaagcacgacttccaggcactgaaagaggacatgagcggctacacaatctacgacacgtccactgacaggctgttgtggcgtgaggccaagctggaccactgcaggcgtgtctccctgcgggtgctgagtgagcgcc

SEQ ID NO: 11473 - DNA, 55 bp, Homo sapiens
ggcacgaggatatgtcctgactcacacagcgaacctacagcagctccctcaaacg

SEQ ID NO: 11474 - DNA, 99 bp, Homo sapiens; identical to SEQ ID NO: 391

SEQ ID NO: 11475 - DNA, 280 bp, Homo sapiens
  misc_feature 219, 225, 229, 237, 240, 247, 248, 250, 251, 252, 254, 259,262, 273: n = A,T,C or G
aattccgttgctgtcgctttgaaatgtaacaaatggtactacaaccaattccaagttttaatttttaacaccatggcaccttttgcacataacatgctttagattatatattccgcactcaaggagtaaccaggtcgtccaagcaaaaacaaatgggaaaatgtcttaaaaaatcctgggtggacttttgaaaagcttttttttttttgaaacggagtnttgctntgtngcccaggntgnagggcannannncnatctnggntaattgcaccntccgttt

SEQ ID NO: 11476 - DNA, 540 bp, Homo sapiens
tcgctttcacagtcagaagtgggtctgtgggatctgtggtccctgtcctccctgctgtcccttctggggaggctttggtggctctgaggtggacaaagagctctcgcaagaagagacagcgtgatgcctcccacagtccaccccagaccctggggcagcccctctggccctgccagctgcctgcgtcgttgggcccagggtggctggcaggagtcccagctgcttgctttaggacctggcagcttttcttgccgtccctcccctgcctccagaatcacagcccttctccccaagggaggctgaggaggcttctccaccagtggcagccccaccccgtccctggccattcttggcctccaccccgctcaggcccctactcgggcgctcccagaaggagccacctctcagtgcctcacctccccctgcctcccagcctccgcagatgaggttcctgccccttcctcctcgtaaccaaaaccctcactgctcccaggacggtcttatttataaaccagatacatgttcttagtctggtcccag

SEQ ID NO: 11477 - DNA, 548 bp, Homo sapiens
gctgtcgaaaaggggagcctttctacatttgctccttctgggccagccgcaaaccattttgcagccctcactggccttgagatgcactttcttctcaacctaaagtggcatcttgacccttggcccttggcctcggcagtgacactgatgacaattcagaccaggctcaccggtgccgtcacttaggaatgctggaacaaaggacatttctcaaagttcccctgaagacatgccatctctagaaccttttttctccccgactctacccccacctctgttcctagagccctctgctggcgagtccagaaacattattgcccagaaggattatgtgtttatggattattttgccccgcctcaggagcgcaggaagtcactaccatttatattctaaaacagacctatctatgttcataggacttctgatgtgttcagataggaatcctcatgagagatcattatgctttgtgccctggaccactgctgctctgggttctcaggaggaacaggcaagagcagcttcattctaagcctttccagtgacctca

SEQ ID NO: 11478 - DNA, 353 bp, Homo sapiens
cggggtaccagaatctggcgagatccggactctaaagccgtgtctgctgcgccgcaactacagccgcgaacagcacggcgtggccgcctcctgcctcgaagacctgaggagcaaggcctgtgacattctggccattgataagtccctgacaccagtcaccctggtcctggcagaggatggcaccatagtggatgatgacgattactttctgtgtctaccttccaatactaagtttgtggcattggctagtaatgagaaatgggcatacaacaattcagatggaggtacagcttggatttcccaagagtcctttgatgtagatgaaacagacagcggggcagggttgaagtgga

SEQ ID NO: 11479 - DNA, 548 bp, Homo sapiens
  misc_feature 374: n = A,T,C or G
cgttgctgtcggtaaatctgagctcagcgcctgcttctctagacttcttgatgctcagaactcaaattccccactcacccatggctgcctggactctcttgcaagcacgacagacatctgccaagccaaacaggcccgaaaccactctggcaccaccatacccacattggaatgctgtcatgaagacatgtgcaattacagagggctgcacgatgttctctctcctcccaggggtgaggcctcaggacaaggaaacaggtatcagcatgatggtagcagaaaccttatcaccaaggtgcaggagctgacttcttccaaagagttgtggttccgggcagcggtcattgccgtgcccattgctggagggctgattntagtgttgcttattatgttggccctgaggatgcttcgaagtgaaaataagaggctgcaggatcagcggcaacagatgctctcccgtttgcactacagctttcacggacaccattccaaaaaggggcaggttgcaaagttagacttggaatgcatggtgccggtcagtgggcacg

SEQ ID NO: 11480 - DNA, 517 bp, Homo sapiens
ctgtttgttagggctgttagagggtgatcttcagttttacaggaagtgggtcacgggttaattttaaatgtgattccgaatctcctttcagtcctcgagaagggccaatgagcatttttcagcagtcacagccagtgtgagtgctgctctttccacctgccttgcaaattctgtttcccaggggaatgtgtctactgcctggtggttcaaaggttggaaggcagggcagaggtgggggctgattctgctgggacaggtcttccagaggcagcctccccccactgcctgtccccgtccccaccaggctgcccttgggatggaccttttcattcttttctttatattctagacagtctctgttgtctcattgtgttgctgtcccatttttcaggtgagggtaccggggtaggggagtggcctgcccagggtcacactatgagaggcccccacctgctgcctttggacgcagccccctgctgctgcatccaccacccttcttacagatcagcgcgcacat

SEQ ID NO: 11481 - DNA, 428 bp, Homo sapiens; identical to SEQ ID NO: 396

SEQ ID NO: 11482 - DNA, 434 bp, Homo sapiens
attggatttaatttcccaaacactgacattttagacaattttgcaaggactctgaatttttgcagggctatttttggatactgtaaaaaaaaaaaaaagaaacaacacacacacacacacacactcatagcagagctgctctgctcgctctaaggcctctttgagggaaggacagttccaaaaggcactgaccggtgacatgggtgggccctgcccctcctcaggcagccagctcagccatggccctgtccaaggggtccacagaccagtaatcatcatcccagccaaggaaccagcccacaaaggagggaggctcaaagccttgcttcaccacggtgatgggcgtccgccgatcccgattggctgggtccgtctcgatgtaccgcttagcagaagtcaaggcttctgtcttttcttcttcttgagaatccttt

SEQ ID NO: 11483 - DNA, 800 bp, Homo sapiens
  misc_feature 5, 7, 8, 16, 20, 23, 24, 26, 30, 75, 82, 93, 101, 117, 124,135, 142, 208, 210, 369, 414, 439, 441, 446, 480, 500, 528,553, 621, 627, 630, 656, 660, 679, 680, 686, 692, 693, 715,718, 743, 771: n = A,T,C or G
attgnanngaaatccnttcnacnngncccnttgcaggatccctcgattcgaattcggcacgagcccaccatcacngaggccntggtagcacgntttcgganaagccatccctgcctnagaagcngagcaggctgnggagcangaagcttcctgacatgggctgcagtcttcctgagcacagggcacaccaagaagcaagccataggcngntctgtgagtcaaagaatgggcccccttatccccagggagctggccagttagattatgggtccaaagggattccagacacttctgagccagtcagctaccacaactctggagtaaaatatgctgcatccgggcaagaatctttaagactgaaccacaaanaggtaaggctctccaaagagatggagcgaccctgggttaggcagncttctgccccagagaaacactccananactgntacaaggaggaagaacacctcactcagtcaatcntcccaccccctaaaccaganaggagtcatagcctgaaactccatcatncccagaacgtggagagggaccccantgtgctgtaccagtaccaaccacacggcaagcgccagagcagtgtgactgttgtgtcccagtatgatnacctgnaanattaccacttgctgcctcagcaccancgangagtcttttggagggggcnngtatgngggacnntttgtgccccccttgggttttnccnattcacaaaaagcaaggaccttatnctttcagcgttgggtcaagggggctttnctgccccccaaaatttttccttgcacatt

SEQ ID NO: 11484 - DNA, 300 bp, Homo sapiens
aggattgctcctgtactggacaccacagttccaaaagcttagtttggaactaagcagctgccattttcctctgatgacacatccagtggacagattatgaaaatctcagcaggtgtgcggtgtccttgtctcgtcaagcaccatcccagcacgtgcccccttgtttctgtgcaggtgtgtgtaactggtgtgtgcaccgtttcgaccatcactgtgtttgggtgaacaactgcatcggggcctggaacatcaggtacttcctcatctacgtcttgaccttgacggcctcggctgccaccg

SEQ ID NO: 11485 - DNA, 536 bp, Homo sapiens
attccgttgctgtcggcggtccgccggatctccagcgctcagtccgcgccgcaggtggtgcttgtctgcagagtcatgacctctttccgcttggccctcatccagcttcagatttcttccatcaaatcagataacgtcactcgcgcttgtagcttcatccgggaggcagcaacgcaaggagccaaaatagtttctttgccggaatgctttaattctccatatggagcgaaatattttcctgaatatgcagagaaaattcctggtgaatccacacagaagctttctgaagtagcaaaggaatgcagcatatatctcattggaggctctatccctgaagaggatgctgggaaattatataacacctgtgctgtgtttgggcctgatggaactttactagcaaagtatagaaagatccatctgtttgacattgatgttcctggaaaaattacatttcaagaatctaaaacattgagtccgggtgatagtttctccacatttgatactccttactgcagagtgggtctgggcatctgcta

SEQ ID NO: 11486 - DNA, 503 bp, Homo sapiens; identical to SEQ ID NO: 3098

SEQ ID NO: 11487 - DNA, 394 bp, Homo sapiens
ttccgtcagtacgcgaaggatatcggtttcattaagaaagacctgagctgtcttccttggcactgcctatggaggtgacacccatctcctccatcatggccatcctgagaccgctcgcgaagcccaagatcatcaaaaagagcaccaagttcactgggaaccagtcagactgatatgtcaaaattaagggtaactggtggaaacacagaggtattaacaacagggttcatagaaggtttgagggccagatctatgcccaacattggttatgggagaaacaaaaagacaaagcacatactgcccagtggcttctggaagttcctggtccacaacgttaaggagctggaagtactgctggtgagcaacaaatcttactgtgttgagatcactcatg

SEQ ID NO: 11488 - DNA, 100 bp, Homo sapiens
gttattcatgattcagctgatcttaacaaaattcgtagcagtggaaccttgaaatgcatgtggctagatttatgctaaaatgattctcagttagcatttt

SEQ ID NO: 11489 - DNA, 372 bp, Homo sapiens
gatggaagggagcatctggagggggggagcttccttgagcagtgggcccaggcctggccctccacacttcattctctgacctttctctctcctcatttcggtgcatgtcctttctgcagctgcctttcagcacaggtggttccactgggggcagctaacgctgagtgacaaggatgggaagccacaggtgcattttactcaagtcttctctagtcaatgaggggcacccagtgcttctagggcaggctgggtggtggtcccctacgtatcagcctctcttactgtactctccgggaatgttaacctttctattttcagcctgtgccacctgtctaggcaagctggcttccccattggcccctgtgggtccac

SEQ ID NO: 11490 - DNA, 360 bp, Homo sapiens
  misc_feature 9, 29: n = A,T,C or G
gaagggctnatgaatgcactatctattcnatgatgaagataccccaccaaacccaaaaaaagagatctctcgaggatccgaattccagatctatgaatcgtagatactgaaaaaccccgcaagttcacttcaactgtgcatcgtgcaccatctcaatttctttcatttatacatcgttttgccttcttttatgtaactatactcctctaagtttcaatcttggccatgtaacctctgatctatagaattttttaaatgactagaattaatgcccatcttttttttggacctaaattcttcatgaaaatatattacgagggcttattcagaagctttggacttcttcgccagaggtttggt

SEQ ID NO: 11491 - DNA, 578 bp, Homo sapiens
tgctgtcgggctcctacatctacgagaagcccctggcggaggggccgcaggtcaccggccccatcgaggtccccgcggcccgagcagaggagcggaaggcgagcggccccccgaaggggcccagcagagcctccagtgtcaccactttcaccggggagcccaacacgtgcccgcgctgcagcaagaaggtgtacttcgctgagaaggtgacgtctctgggcaaggattggcaccggccctgcctgcgctgcgaacgctgcgggaagacactgacccccggcgggcacgcggagcacgacggccagccctactgccacaagccctgctatggaatcctcttcggaccctgcgtgtccccgtggcgctgtccgctctccctctcctgctgcccacccacctgccagtgttatttatgctcccttcgtgggtgatggccacgccctcaccatgtccctggcagagggcttccctccgggatcccctgcctggtgcccacactgcctcgcaagcgctcgccaccctcacgtggctcacctgctgttgagccttgtgctgtcaataaacggtttgaggattgc

SEQ ID NO: 11492 - DNA, 396 bp, Homo sapiens
ggcacgaggcgccatggcgcctttcagttagttcttcaatgggggaaactggaagatgaacgggcggaagcagagtctgggggagctcatcggcactctgaacgcggccaaggtgccggccgacaccgaggtggtttgtgctccccctactgcctatatcgacttcgcccggcagaagctagatcccaagattgctgtggctgcgcagaactgctacaaagcgactaatggggcttttactggggagatcagccctggcatgatcaaagactgcggagccacgtgggtggtcctggggcactcagagagaaagcatgtctttggggagacagatgagctgattgggcacaaagtggcccatgctctggcatagggactcggagtaaacgcctgcag

SEQ ID NO: 11493 - DNA, 508 bp, Homo sapiens
cgatctacatgggccgcaacccccgggacgttgtggtctccctctatcattactccaagatcgccgggcagttaaaggacccgggcacacccgaccagttcctgagggacttcctcaaaggcgaagtgcagtttggctcctggttcgaccacattaagggctggcttcggatgaagggcaaagacaacttcctatttatcacctacgaggagctgcagcaggacttacagggctccgtggagcgcatctgtgggttcctgggccgtccgctgggcaaggaggcactgggctccgtcgtggcacactcaaccttcagcgccatgaaggccaacaccatgtccaactacacgctgctgcctcccagcctgctggaccaccgtcgcggggccttcctccggaaaggggtctgtggcgactggaagaaccacttcacggtggcccagagcgaagccttcgatcgtgcctaccgcaagcagatgcgggggatgccgaccttcccctgggatga

SEQ ID NO: 11494 - DNA, 506 bp, Homo sapiens
ccggctgagccgacggattttgcagcaagcacggcagcaacaggaggaactcgaggccgagcatgggactggggacaagcccgcggcgccgcgggaacgcaccacgcggctgggtccaagaatgcctcaggatggatcagatgacgaggacgaggagtggcccaccctggagaaggctgccacaatgacagcagcgggccatcatgcagaggtggttgtggaccctgaggatgagcgtgccatagagatgttcatgaacaagaaccctcctgccaggcgcaccctggctgacatcatcatggagaagctgactgagaagcagacagaggttgagacagtcatgtcagaggtgtcgggcttccctatgccccagctggacccccgggtcctagaagtgtacaggggggtccgggaggtattatctaagtaccgcagtggaaaactgcccaaggcatttaagatcatccctgcactctccaactgggagcaaatcctctacgtcacag

SEQ ID NO: 11495 - DNA, 369 bp, Homo sapiens
ggcacgagagaacctgatgtagcccctggccagataactgcctgatttctcagatattatttctctgggaaacattctacatagcacaggagcttaagagtggcattatcttctcgccttaatttccagagattatttctgtactgagaatcctggaactactatgctaggaaatttaaagctgcatgggctgtcttgtttacatttaattattgtgaatacctagaatctttcttggtcctgatttctcttgcttaatccagtctttatctgtaactgccccttatttgatcaccatgtactaggagctctgatagccagctcagctcctaatccttgaggcaacattctttttctatttgaacttca

SEQ ID NO: 11496 - DNA, 485 bp, Homo sapiens
gtggcacagtagactgtagtgtgaggctcgcgggggcagtggccatggaggccgtgctgaacgagctggtgtctgtggaggacctgctgaagtttgaaaagaaatttcagtctgagaaggcagcaggctcggtgtccaagagcacgcagtttgagtacgcctggtgcctggtgcggagcaagtacaatgatgacatccgtaaaggcatcgtgctgctcgaggagctgctgcccaaagggagcaaggaggaacagcgggattacgtcttctacctggccgtggggaactaccggctcaaggaatacgagaaggccttaaagtacgtccgcgggttgctgcagacagagccccagaacaaccaggccaaggaactggagcggctcattgacaaggccatgaagaaagatggactcgtgggcatggccatcgtgggaggcatggccctgggtgtggcgggactggccggactcatcggacttgctgtg

SEQ ID NO: 11497 - DNA, 413 bp, Homo sapiens; identical to SEQ ID NO: 3106

SEQ ID NO: 11498 - DNA, 267 bp, Homo sapiens; identical to SEQ ID NO: 403
  misc_feature 233, 238, 245, 249, 251, 261, 262, 266: n = A,T,C or G

SEQ ID NO: 11499 - DNA, 514 bp, Homo sapiens; identical to SEQ ID NO: 3107
  misc_feature 232: n = A,T,C or G

SEQ ID NO: 11500 - DNA, 309 bp, Homo sapiens
gaagccagccatcttaaaactctgtttgtcaaaggcctgtctgaggataccactgaagagacattaaaggagtcatttgacggctccgttcgggcaaggatagttactgaccgggaaactgggtcctccaaagggtttggttttgtagacttcaacagtgaggaggatgccaaagctgccaaggaggccatggaagacggtgaaattgatggaaataaagttaccttggactgggccaaacctaagggtgaaggtggcttcgggggtcgtggtggaggcagaggcggctttggaggacgaggtggtggt

SEQ ID NO: 11501 - DNA, 546 bp, Homo sapiens
aatttgccttgaatttcaaccccagtaacccctactgtgcaggcatccagggcattgtggatgcctaccgccaagccctgccccaagttcgcctctatggccctaccaactttgcacccatcatcaaccatgtggccaggtttgcagcccaggctgcacatcaggggactgcctcgcaatacttcatgctgttgctgctgactgatggtgctgtgacggatgtggaagccacacgtgaggctgtggtgcgtgcctcgaacctgcccatgtcagtgatcattgtgggtgtgggtggtgctgactttgaggccatggagcagctggacgctgatggtggacccctgcatacacgttctgggcaggctgctgcccgcgacattgtgcagtttgtaccctaccgccggttccagaatgcccctcgggaggcattggcacagaccgtgctcgcagaagtgcccacacaactggtctcatacttcagggcccagggttgggccccgctcaagccacttccaccctcagccaaggatcctgcacaggcccccc

SEQ ID NO: 11502 - DNA, 697 bp, Homo sapiens
  misc_feature 353, 630, 653, 676, 690: n = A,T,C or G
ggcacgaggtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactagttttgttaggaacatttgagttacttcaatcattttcacaggcagccaacaagcaattaagagcagttataatanaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacaagtgaacacactggggagacgtgctttttttggaaaactcaaaagngctagctcctgattcaaagaaanatttctcatgttggtcattctangtttatattttcanttaaaat

SEQ ID NO: 11503 - DNA, 360 bp, Homo sapiens
tcattctgtggaattttgtgcttactactgtatagtgcatgtggtgtaggttactctaactggttttgtcgacgtaaacatttaaagtgttatattttttataaaaatgtttatttttaatgatatgagaaaaattttgttaggccacaaaaacactgcactgtgaacattttagaaaaggtatgtcagactgggattaatgacagcatgattttcaatgactgtaaattgcgataaggaaatgtactgattgccaatacaccccaccctcattacatcatcaggacttgaagccaagggttaacccagcaagctacaaagagggtgtgtcacactgaaactcaatagttgagtttggct

SEQ ID NO: 11504 - DNA, 550 bp, Homo sapiens
aaacctgcgccctggcctctcactccgggagctcaggctccaagtcgggaggcgacaagatgttctccctcaagaagtggaacgcggtggccatgtggagctgggacgtggagtgcgatacgtgcgccatctgcagggtccaggtgatggatgcctgtcttagatgtcaagctgaaaacaaacaagaggactgtgttgtggtctggggagaatgtaatcattccttccacaactgctgcatgtccctgtgggtgaaacagaacaatcgctgccctctctgccagcaggactgggtggtccaaagaatcggcaaatgagagtggttagaaggcttcttagcgcagttgttcagagccctggtggatcttgtaatccagtgccctacaaaggctagaacactacaggggatgaattcttcaaataggagccgatggatctgtggtcctttgggactcatcaaagccttggtttagcattttgtcagttttatcttcagaaattctctgcgattaagaagataatttattaaaggtggtccttcctacctctg

SEQ ID NO: 11505 - DNA, 443 bp, Homo sapiens; identical to SEQ ID NO: 2999

SEQ ID NO: 11506 - DNA, 623 bp, Homo sapiens; identical to SEQ ID NO: 2763
  misc_feature 537: n = A,T,C or G

SEQ ID NO: 11507 - DNA, 495 bp, Homo sapiens
ggcttagcggataacaatttcacacaggatgatgctaccaatcaatactcatcattaataatcataatggctatagcaataaaactaggaatagccccctttcacttctgagtcccagaggttacccaaggcacccctctgacatccggcctgcttcttctcacatgacaaaaactagcccccatctcaatcatataccaaatctctccctcactaaacgtaagccttctcctcactctctcaatcttatccatcatagcaggcagttgaggtggattaaaccaaacccagctacgcaaaatcttagcatactcctcaattacccacataggatgaataatagcagttctaccgtacaaccctaacataaccattcttaatttaactatttatattatcctaactactaccgcattcctactactcaacttaaactccagcaccacgaccctactactatctcgcacctgaaacaagctaacatgactaacaccc

SEQ ID NO: 11508 - DNA, 124 bp, Homo sapiens
gggtttttaaaggttattaaaaacccaccttaaaatgggcctccaaactttaccctaaaagggtttaaaacccaagggttaaaatccttttgcaaccgggcaaaaaaaacccttttttcttttt

SEQ ID NO: 11509 - DNA, 150 bp, Homo sapiens
ggcttgtaatacgactcactatagggcttttttttttttaaagtgggaaaacccttttttgggcccaggctttccttgtaaactggacggggggaacctattttttcaaaaccagaaaaagcgggtttccccaaaactatttcccttggg

SEQ ID NO: 11510 - DNA, 385 bp, Homo sapiens
ggtacaacattgatgttttaatatagaatgaagtgcttgctacacagtcaagtaaatcaacatatccattaccacacacacttttcttttctgaggagcggtaagagtactttaattttgcagttattgattaattaaaaaacacagttgttttcagcatttcctagttacagtagtgcataggaaattccattctaaacaaagaagtaattaatgaaataacaacacaccttaacattttacattgataggttacagtttacaaggtgctttcacatacattatttcatttgattcttacaacaagcagaaaaaacagtgggaaagattttttttttcaggcttacaatgagtattttcaggccaatgggcagttaacacaagg

SEQ ID NO: 11511 - DNA, 392 bp, Homo sapiens; identical to SEQ ID NO: 3113
  misc_feature 392: n = A,T,C or G

SEQ ID NO: 11512 - DNA, 541 bp, Homo sapiens
ggcacgaggtggaggcagctaaaagccatctcatctttcaccgtattcaacaagcccattataacaagtctttcacgctcaaccattcaaacaatcccaacaatcccagcctaagaatttcctggcatttgatgaaaatggctgtgggttttgctatctttaagctccctgcgaagcatgatataagcccacggctggcaggctctttctagctacctgctcttgcacatagagtttgcctcatggttgcaagaaagctgccatagctccagatggcacatagacattccaggcagcaggaaaaaggaaggagcacttaaccgaaggaggtcagggagttggttagtctccacctgaagaagagagccatgaaccagcttcagttgactaacgggctcctgtgagtgcatctttggacttttctggaggttgaaatctacatgtggtatgtgtcttaaagcagccaccaactgctcccattaccttccaagtgagcccaactacacgatggagcctcttccctgcccttggatctgggctg

SEQ ID NO: 11513 - DNA, 539 bp, Homo sapiens
ggcacgagggatccagtttcctggtcatccccttagcagttcacaagttcctggcaaatgttccaaagcaaaaagcgattgcaattagcatccagttcctgcagcctggtgctctgccctgcacgtcagggttggcatccacccagatccagatggaagggaaacttctctcttctcctttgcctcctcttccctcaccagagcagggcgcttctcttggggtggtgagaaggatcttcgagaaatcgtgttcagtatttcaagctctatttctgtggcacatgtcttttgagaggcatcttcacctcttctgtgatgacttggtatgttgtttggtagagagatcttgattttcggaggatcttgcatttttctagggaatattttgtagttgtgtgtgtgtgtttttgccttggtccccattatgggatgcattaggactggcctatgcatcgaaaatctttttgtttgtaaacgtttaaaaacaaagttccccggccaggcacagtggctcacacctgtaatcccagcactttggg

SEQ ID NO: 11514 - DNA, 564 bp, Homo sapiens; identical to SEQ ID NO: 3116

SEQ ID NO: 11515 - DNA, 626 bp, Homo sapiens
ttgaggaattccttagtaaagtctctattttagagtctctggacaagtgggaacgtcttacggtagctgatgcattggaaccagtgcagtttgaagatgggcagaagattgtggtgcagggagaaccaggggatgagttcttcattattttagaggggtcagctgctgtgctacaacgtcggtcagaaaatgaagagtttgttgaagtgggaagattggggccttctgattattttggtgaaattgcactactgatgaatcgtcctcgtgctgccacagttgttgctcgtggccccttgaagtgcgttaagctggaccgacctagatttgaacgtgttcttggcccatgctcagacatcctcaaacgaaacatccagcagtacaacagttttgtgtcactgtctgtctgaaatctgcctcctgtgcctcccttttctcctctccccaatccatgcttcactcatgcaaactgctttattttccctacttgcagcgccaagtggccactggcatcgcagcttcctgtctgtttatatattgaaagttgcttttattgcaccattttcaatttggagcattaactaaatgctcatacacagttaaataaatagaaagagttctatgga

SEQ ID NO: 11516 - DNA, 490 bp, Homo sapiens
tttagcttagggcctggtggctaggtcggttctctcctttccagtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctctattggagattacaatgattaaatcaataaataactgaaacttg

SEQ ID NO: 11517 - DNA, 502 bp, Homo sapiens
aattccgttgctgtcgggtcctccgggacttggaacgccctggctgggtggtgtccgggcgtcctttccgcgcttcttcccacctcggctggtcccgtttcctcctgcgcccagtgcggacctgtctcggcgcccgctgccctctcaccgccccacgcaggatcccggcctggtcaccgggcagtgtgatgcttcccgactgccgcggggacagcgaggcacacacagggcttgggccgcgccggaggccacacggcctggctgagttgctcctggtctcccgcctgtcccaggcgacccggatgtagcatttcccaggaggcacggtcccccccatggggatgggcacagtcacgccagatggacgagaagaccaagaaagcagaggaaatggccctgagcctcacccgagcagtggcgggcggggatgaacaggtggcaatgaagtgtgccatctggctggcagagcaacgggtgcccctgagtgtgcaactgaagcctg

SEQ ID NO: 11518 - DNA, 300 bp, Homo sapiens; identical to SEQ ID NO: 437

SEQ ID NO: 11519 - DNA, 556 bp, Homo sapiens; identical to SEQ ID NO: 3117

SEQ ID NO: 11520 - DNA, 493 bp, Homo sapiens
aattccgttgctgtcgcaaggggatggggctgtgggggcggtgcggcatgggcttcaaaagtatctgcacaattagaaaagtcctcagaagctttttcttggagggtacactttcttcactgtccctattcctagacctggggcttgagctgaggatgggacgatgtgcccagggagggacccaccagagcacaagagaaggtggctacctgggggtgtcccagggactctgtcagtgccttcagcccaccagcaggagcttggagtttggggagtggggatgagtccgtcaagcacaactgttctctgagtggaaccaaagaagcaaggagctaggacccccagtcctgccccccaggagcacaagcagggtcccctcagtcaaggcagtgggatgggcggctgaggaacggggcaggcaaggtcactgctcagtcacgtccacgggggacgagccgtgggttctgctgagtaggtggagctcattgctttc

SEQ ID NO: 11521 - DNA, 270 bp, Homo sapiens
ccgttgctgtcggtgggctggcccctggtgtgagcattagaccagccacagtgcctgattggtatagccttatgtgctttcctacaaaatggaattggaggccgggcgcagtggctcacgcctgtaatcccagcactttgggaggccaaggtgggtggatcacctgaggtcaggagctcgagaccagcctggccaacatggtgaaaccccatctctactaaaaatacaaaaattagccaggtgtgatggtgcatgcctgtaatcccagct

SEQ ID NO: 11522 - DNA, 460 bp, Homo sapiens
attccgttgctgtcggatggcgctagcggttggagcaggggctctgctgcgacctttacggtagtgaggttagggacgatgggagagcagctttgttcctgaagtgccgtcgaggattaggatcgagtttcttcgatcgtgagggcaattattagtggcctctagccccccagatggcatcttgaggagagagaatccacgctacgagaactaacatagtggacatcgcagttgtccgtagccgatttgcgggttacggagttgttgcaagtaaagaaggggaaatccgagcgttctcgcgttggatttcctccacgtgtgaagtgggaatggtagtgatatctcgtgctatctctgtcaagggcaagaaggagaaggaatttatttgaggccctacgacgtggtgcggtggctcacgcctgtaatcccaacactttgggaggccgaggcacgcggatca

SEQ ID NO: 11523 - DNA, 575 bp, Homo sapiens
tcggccgccgcctcctttcgtgtgccgctatgggagtcccggcgttcttccgctggctcagccgcaagtacccgtccatcatagtcaactgcgtggaagagaagccaaaagaatgcaatggtgtaaagattccagttgatgccagtaaacctaatccaaatgatgtggagtttgataatctgtatttggatatgaatggaatcatccatccctgtactcatcctgaagacaaaccagcaccaaaaaatgaagatgaaatgatggttgcaatttttgagtacattgacagacttttcagtattgtaagaccaagaagacttctctacatggcaatagatggagtggcaccacgtgctaaaatgaaccagcagcgttcaaggaggttcagggcatcaaaagaaggaatggaagcagcagtcgagaagcagcgagtcagggaagaaatattggcaaaaggtggctttcttcctccagaagaaataaaagaaagatttgacagcaactgtattacaccaggaactgaattcatggacaatcttgctaaatgccttcgctattacatagctgatcgttta

SEQ ID NO: 11524 - DNA, 609 bp, Homo sapiens
tcggcctggcccaagccctgacgatttcagtgttgttttctgcacgcgcaaaacacctggggaccgaggggatggcagtggcatcctatctttgacagctctgaacgagcttaaccttttttttcagacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagc

SEQ ID NO: 11525 - DNA, 453 bp, Homo sapiens
agaatacaggagaatctgaagctagtggaaataaagagatgattgaagcactaaagcaatatgctatggactattcgaataaagctcttgagaagggactgaatcctctgaatgcatactccgatctcgctgagttcctggagacggaatgttatcagacaccattcaataaggaagtccctgatgctgaaaagcaacaatcccatcagcgctactgcaaccttcagaaatataatgggaagtctgaagacactgctgtgcaacatggtttagagggtttgtccataagcaaaaaatcaactgacaaggaagagatcaaagaccaaccacagaatgtatctgaaaatctgcttccacaaaatgcaccaaattattggtatcttcaaggattaattcataagcagaatggagatctgctgcaagcagccaaatgttatgagaaggaactgggcc

SEQ ID NO: 11526 - DNA, 552 bp, Homo sapiens; identical to SEQ ID NO: 3121

SEQ ID NO: 11527 - DNA, 590 bp, Homo sapiens; identical to SEQ ID NO: 3122
  misc_feature 362: n = A,T,C or G

SEQ ID NO: 11528 - DNA, 300 bp, Homo sapiens
aattccgttgctgtcggtggagggccgcccgaagggcactctcggacattaacccgcattctggtgggtctagaggaaattggcggacgaagagtggcagcactgacctggtctgggacgtggggagaagggtgcgctacctgggtttcaggtgggagggcgttcggtcgggcctccagggggatagcgggggtgcttgagtcgcgggtgctgagtcgggagtgctgagtgagttgcgggtgctgagttgaggctgtgccctttcccactataatacgccaagcgtgcgttctgccgttc

SEQ ID NO: 11529 - DNA, 519 bp, Homo sapiens; identical to SEQ ID NO: 3124

SEQ ID NO: 11530 - DNA, 501 bp, Homo sapiens; identical to SEQ ID NO: 3125

SEQ ID NO: 11531 - DNA, 387 bp, Homo sapiens
cccctcgctgacatccaccccagtgtgcagccagaaggtggtggtcaccacaccactgcaccgggacaagacacccctgcaccagaaacatgctgcgtttgtaaccccagatcagaagtactccatggacaacactccccacacgccaaccccgttcaagaacgccctggagaagtacggacccctgaagcccctgccacagaccccgcacctggaggagacttgaaggaggtgctgcgttctgaggctggcatcgaactcatcatcgaggacgacatcaggcccgagaagcagaagaggaagcctgggctgcggcggagccccatcaagaaagtccggaagtctctggctcttgacattgtggatgaggatgtgaagctgatgatg

SEQ ID NO: 11532 - DNA, 436 bp, Homo sapiens; identical to SEQ ID NO: 416

SEQ ID NO: 11533 - DNA, 525 bp, Homo sapiens
ggtcgtccctgccctccccggccccggggtgcaccccgcaaggctcccgctggtgtccctggagcatgggaggctgctgagcgtgagtggcggtgtctggcaggagctgcgtggcagggagggcgtccatggctgcagccaacaagggcaacaagcccagagtccggagtatccgctttgcggcaggccacgatgcagaaggatcccacagccacgtccactttgatgagaagctgcatgactcggtggtcatggtcacccaggagagtgacagcagctttctggtcaaggttggcttcctgaagatcctgcacaggtatgagattaccttcactctgcccccagtgcacaggctgagcaaggatgtccgcgaggcacctgtccccagcctgcacctcaagctcctcagcgtggtgcccgtccctgaaggttatagtgtcaagtgtgagtactcggcgcacaaagagggcgtcctcaaagaggagatactgctagcctgcgaaggtggcactggcacctgtgtgc

SEQ ID NO: 11534 - DNA, 354 bp, Homo sapiens
ggcacgaggctggaagacatggccactccagtcggtgttgagcacggcgagcagtctcaggcctttagtgatgatggtgcagtcagcctcagtttccaaagccggaaaaggatcctctagtagccacggtgtggcagctgctctgaaccaggacctggacccggacccaaagtgccatgtctttaatgttagctcccagcgatgccaatgggatcagcacagccctgcctctgctgctaattgttcctctaaagtaatcgccatgcgttctttgggcttcatctttaaaggaatgaagcaactgagattattctggaaaaccttttggcagttagtgaaattagagtacaacta

SEQ ID NO: 11535 - DNA, 376 bp, Homo sapiens; identical to SEQ ID NO: 3126

SEQ ID NO: 11536 - DNA, 321 bp, Homo sapiens; identical to SEQ ID NO: 3128

SEQ ID NO: 11537 - DNA, 504 bp, Homo sapiens
caatttgttctgcttagtcattacttttaattcttttcttactaaaattttatggtggttgggggaagggagttagcatcactaacctgacagttgttgccaggaatttgctttgtttactgctagtatattagaaatcctagatctcagaatcacaatagtaataaacaacaggggtcattttttcctaacttactctgtgttcaggtgtggaatttctgtctcccaagaggaaatgtgacttcactttggtgccaatggacagaaaattctacctgtgctacataggagaagtttggaatgcacttaatagctggtttttacaccttgatttcgaggtggaaagaaattgatcatgaatctctaataaatttaaatctcttaaaccagtaggtgcttaatattttttgatttgattaatgcccatttaaatctcatgggttctattaaaaatatatatatatagggccccaatccattgccatcaaattgcccttggacttt

SEQ ID NO: 11538 - DNA, 388 bp, Homo sapiens
ggcacgagaccacgtccagttcttcagcagactcaactatcatggacattcaggtcccgacacgagccccagatgcagtctacacagaactccagcccacctctccaaccccaacctggcctgctgatgaaacaccacaaccccagacccagacccagcaactggaaggaacggatgggcctctagtgacagatccagagacacacaagagcaccaaagcagctcatcccactgatgacaccacgacgctctctgagagaccatccccaagcacagacgtccagacagacccccagaccctcaagccatctggttttcatgaggatgaccccttcttctatgatgaacacaccctccggaaacgggggctgttggtcgcagctgtgct

SEQ ID NO: 11539 - DNA, 579 bp, Homo sapiens
ggcacgagccagagccttctctctcctgtgcaaaatggcaactcttaaggaaaaactcattgcaccagttgcggaagaagaggcaacagttccaaacaataagatcactgtagtgggtgttggacaagttggtatggcgtgtgctatcagcattctgggaaagtctctggctgatgaacttgctcttgtggatgttttggaagataagcttaaaggagaaatgatggatctgcagcatgggagcttatttcttcagacacctaaaattgtggcagataaagattattctgtgaccgccaattctaagattgtagtggtaactgcaggagtccgtcagcaagaaggggagagtcggctcaatctggtgcagagaaatgttaatgtcttcaaattcattattcctcagatcgtcaagtacagtcctgattgcatcataattgtggtttccaacccagtggacattcttacgtatgttacctggaaactaagtggattacccaaacaccgcgtgattggaagtggatgtaatctggattctgctagatttcgctaccttatggctgaaaaacttggcattca

SEQ ID NO: 11540 - DNA, 476 bp, Homo sapiens
ggcacgaggttaggatggctgtagtacctctgctgttgttggggggtttgtggagcgctgtgggagcgtccagcctgggtgtcgttacttgcggctccgtggtgaagctactcaatacgcgccacaacgtccgactgcactcacacgacgtgcgctatgggtcaggtagtgggcagcagtcagtgacaggtgtaacctctgtggatgacagcaacagttactggaggatacgggggaagagtgccacagtgtgtgagaggggaacccccatcaagtgtggccagcccatccggctgacacatgtcaacactggccgaaacctccatagtcaccacttcacttcacctctttctggaaaccagtgagtgcttttggtgaggaaggtgaaggtgattatctggatgactggacagtgctctgtaatggaccctactgggtgagagatggtgaggtgcggttcaaacactcttccactg

SEQ ID NO: 11541 - DNA, 485 bp, Homo sapiens; identical to SEQ ID NO: 3131

SEQ ID NO: 11542 - DNA, 463 bp, Homo sapiens; identical to SEQ ID NO: 3133

SEQ ID NO: 11543 - DNA, 333 bp, Homo sapiens
ggcacgagggaacgtcatcgtttggaaagcgtcgcaataagacgcacacgttgtgccgccgctgtggctctaaggcctaccaccttcagaagtcgacctgtggcaaatgtggctaccctgccaagcgcaagagaaagtataactggagtgccaaggctaaaagacgaaataccaccggaactggtcgaatgaggcacctaaaaattgtataccgcagattcaggcatggattccgtgaaggaacaacacctaaacccaagagggcagctgttgcagcatccagttcatcttaagaatgtcaacgattagtcatgcaataaatgttctggtttt

SEQ ID NO: 11544 - DNA, 436 bp, Homo sapiens
ggcttgtaatacgactcactatagggctttttttttttcaataaatctcctaaggggatggctaccttttctatctaaataataatatatagacctattcgatcagagatacaggggactaacaatcacaatcctgtgatcgacatccgaacataagtcactatctatcagaataaacaatgatccaacgaataatagaggagtaagtggacatgtccaaagcatcaggtttcatcatgatcgagaaccgctgtcaagcaagacacaaacaaacaaaacagctttacacacaagtcagcagtccaagcgttcatgtcccaaggtcaaatgtaatcatcctgtcataagtcctcggccattgaaaaccaaataaatcgtcgtttaaacgcgctccacaaattgagcatttccagtattcttccttgtactggggctc

SEQ ID NO: 11545 - DNA, 85 bp, Homo sapiens
gagtgagagtgtaaacagtgtagggggtggttgagagtaagaaacccggagccttgtgccttgagactcctggaaagactcaatg

SEQ ID NO: 11546 - DNA, 405 bp, Homo sapiens
  misc_feature 387: n = A,T,C or G
cgttgctgtcgggtgacccagccgtctatgccgaaagggctggctatgataaactgtggcacccagcttgttttgtctgcagcacctgccatgaactcctggctgacatgatttatttttggaagaatgagaagctatactgtggcagacattactgtgacagcgagataccccgatgtgctggctgtgacgagctgatattcagcaatgaggatacccaggcagaaaaccagaaatggcacctgaaacacttctgctgctttgactgtgatagcattctagctggggagatatacgtgatggtcaatgacaagcccgtgtgcaagccctgctatgtgaagaatcacgctgtggtgtgtcaaggatgccacaatgccatcgacccanaagtgcagcgggtgacct

SEQ ID NO: 11547 - DNA, 409 bp, Homo sapiens
cgttgctgtcgcaaggatctccattctccctgtctggatacttctttggcagagatatgtcctttaggaaaaaatctcagctctaaagttaattcagacagcggtattccaggactagcagccagtgccttacttgtgagtcacggtgcttacatcagaagcctgtttgactattttctgactgaccttatgtgtgccttaccagccactctgagcatatatgaacgtatgtcagttactcccaatacagggatgagtctctctatcatacactttcgtgacggaatgagaagttaaaccaacggttcagtgtattcgtatgaacctacaggatcatcgaaatggactgactgatactcgctgcggataaatctgcatcactatctaaccattttgagcctctgaaggg

SEQ ID NO: 11548 - DNA, 462 bp, Homo sapiens
ccgttgctgtcgctttcttcttgcacctaaaagtggtgtctgggtgcaaatgtaagcagtggtggatccagaaatatgagctttgtgtaataagcttcttaaaacagtcctttcttacacctgcccagggccagaccctcggtcttggcctttttcaggagctaggatatctgcgcctggtgaaaatgaaacgaattcctgatttaggaattcagtgtttcctcctcactccagctaagcactcactttttttttttttttttaaaaaaaaatttttttttttcccccagggggggggggagggggggaattttggtttattgaaacccccccccccgggggtaaaagaatttttttgcccacccccccggaaaaaaggggaaaaaagggttgcccccccttgcccaattttttttttttttttttaaaaaaaaaatttttttttttcccccgggggggggg

SEQ ID NO: 11549 - DNA, 557 bp, Homo sapiens
ttccgttgctgtcgcttatgtttcaaagagaatttgccctccgactggttgcaaaacctggagataagttatactgcagactctcaattaatacacagctgttggcacgtgtggaccatctaatgaaagtgggaaagaataacttcagaccaccgcccaaggtggaatccagtgttgtaaggatagaacctaagaatccaccaccacccatcaattttcaggaatgggatggtctagtaaggataacctttgttaggaaaaacaagacactctctgctgcatttaaatcaagtgcagtgcaacaactcttggaaaaaaactacagaattcactgttcagtccataatattataataccagaagatttcagcatagcagataaaatacagcaaatcctaaccagcacaggttttagtgacaaacgggcccgttccatggacatagatgacttcatcagattgctacatggattcaacgcagaaggtattcatttttcctaggtatttggaaaacagaaattttcaaggtcaagaaaagaaatgaattttgtatttttt

SEQ ID NO: 11550 - DNA, 502 bp, Homo sapiens
ccgttgctgtcgggcggccgtgtggcgcggctgctcgccccactaatgtggcgcagggcggtttcctcggtggcggggtccgcggttggagccgagcccgggcttcggctgctggccgtgcagcggcttcccgtaggagcagcgttctgccgggcttgccagaccccaaactttgtccgcggcctgcacagcgagcctgggctggaggagcgggcggaggggacggtcaacgagggacgcccagaatcggacgcggcagatcatactggtcccaagtttgacatcgatatgatggtttcacttctgaggcaagaaaatgcaagagacatttgtgtgatccaggttcctccagaaatgagatatacagattactttgtgattgttagtggaacttctacccgacacttacatgccatggccttctacgttgtgaaaatgtacaaacacctgaaatgtaaacgtgaccctcatgttaagatagaagggaaggacactgatgact

SEQ ID NO: 11551 - DNA, 213 bp, Homo sapiens
ctgggattacacgcgcccaccaccatgcctggttaattgtttatttatagtggagacggggtttcaccatgttgaccagactggtctcgaacttctgacctcaagtgatccgcccgcctcggccactaaaagtgctggaattacaggcgtgagccaccatgcccggccccatttcctttattttatttattatttcgagaaggagtttcgctc

SEQ ID NO: 11552 - DNA, 586 bp, Homo sapiens
ccgttgctgtcgggcggtgacggcgtcaccctcaccagctctggaaaaagatccactggaaactaggccgggaagcagcagcccctccaagggccagggcacctgggagacgggaggattccagaacagcagcactgagctcccacccgcagagcctctggacggccttggcaacagcaaaatcatgggacaacacctctctccacggaaaggtcacagtggacagcccgggcagtaggatgcagccccagaggctggtggcagtttcctgtccattggtaggtgacggcccctggctcaggcagagggagatggttagactcttgcagggctaaaactctaatttggaattgaatattgtggatatcttagttaaaggccatgcttacagcttagaaatgaagccttaagctgcatcaagttacgaagtgattaatttccttctcagcaaacctccgggaggttccagaatgagttcttcctgacaggttgtcttcactgggagcgtggggcccccaggccccaccagcaccgtcctcccctaatgaggggccctgccgaggcatcagctgctctgctcagttag

SEQ ID NO: 11553 - DNA, 50 bp, Homo sapiens
gcctggttcacaggcttagtgatggagatatgacctcagccctaaggggg

SEQ ID NO: 11554 - DNA, 422 bp, Homo sapiens
cgccgagtggttcccagcgacctgtatcccctcgtgctcggtttcctgcgcgataaccaactctcagaggtggccaataagttcgccaaagcgacaggagctacacagcaggatgccaatgcctcttccctcttagacatctatagcttctggctcaagtctgccaaagtcccagagcgaaagttacaagcaaatggaccagaggctaataaagctaagaagaaggcctcatccagtgacagtgaggacagcagcgaggaggaggaggaagttcaagggcctccagcaaagaaggctgctgtacctgccaagcgagtcggtctgcctcctgggaaggctgcagccaaagcatcagagagtagcagcagtgaagagtccagtgatgatgatgatgaggaggaccaaaagaaacagcctgtcca

SEQ ID NO: 11555 - DNA, 50 bp, Homo sapiens
taaccggccggaagtttttcgtaggcctctccaaatggaccaatcaccga

SEQ ID NO: 11556 - DNA, 376 bp, Homo sapiens
cgttgctgtcggtggcattacaattagtagtgggcattacactgcttctgttaaagtcactgaccttaacagtttagaactagataaaggaaattttgtggttgaccaaatgtgtgaaataggtaagccagaaccattgaatgaggaggaagcaaggggtgtggttgagaattataatgatgaagaagtgtcaattagagttggtggaaatacacagccaagtaaagttttgaacaaaaaaaatgtagaagctattggacttcttggaggacaaaagagcaaagcagattatgagctatacaacaaagcctctaatcctgataaggttgctagtacagcgtttgctgaaaatagaaattctgagactagtgatact

SEQ ID NO: 11557 - DNA, 372 bp, Homo sapiens
ttttgcattaagaaagctttatgttaaagtatgaacagcatttccaataaaacatgaaaagattcatattgtatctacaaaatttaagtctttgctacaataaatgctatatttcttttaaacaagcctaagaaggtaaggaatgtcatgatcaatccgtacattctctttgcagcataagcctggagactttgatgtttaaattggacaatcatagatgtgaatttcctggtcatctccaacagacacaatttttgaaccatttccattgtattttactccccagacctgatcctggtgatcaaagaaggtgtgaacacaagtcctcgttccaacatcccaaacttttacacttttgtcagacgaactgga

SEQ ID NO: 11558 - DNA, 219 bp, Homo sapiens
ctatctgcccaccttggcctcccaagtgctgggattacaggtgtgagccactgtgcccggcctgtattgttttaagttacacttattccttttaaaattcagaatttgttaagcatttaaaacaaattcataaattaaaacctccttgagataccatttaccatgtagtttgatgaacataatacatggtgcattacattggcaaaagcaggggggaaa

SEQ ID NO: 11559 - DNA, 633 bp, Homo sapiens
  misc_feature 487, 600, 606, 614: n = A,T,C or G
acgcgggggttgcaccatggcgtccatggggaccctcgccttcgatgaatatgggcgccctttcctcatcatcaaggatcaggaccgcaagtcccgtcttatgggacttgaggccctcaagtctcatataatggcagcaaaggctgtagcaaatacaatgagaacatcacttggaccaaatgggcttgataagatgatggtggataaggatggggatgtgactgtaactaatgatggggccaccatcttaagcatgatggatgttgatcatcagattgccaagctgatggtggaactgtccaagtctcaggatgatgaaattggagatggaaccacaggagtggttgtcctggctggtgccttgttagaagaagcggagcaattgctagaccgaggcattcacccaatcagaatagcccgatggctatgagcaggctgctcgcgttgctattgaacacctggacaagatcagcgatagcgtccttgntgacataaaggacaccgaacccctgattcagacagcaaaaaccacgctgggctccaaaagtggtcaacagttgtcaccgacagatggctgaaaatgctgtgaatgccgtcctnctgtancagatatngaaccggaaaagaccttga

SEQ ID NO: 11560 - DNA, 173 bp, Homo sapiens; identical to SEQ ID NO: 3140

SEQ ID NO: 11561 - DNA, 645 bp, Homo sapiens
  misc_feature 493, 548, 605, 607, 644, 645: n = A,T,C or G
ggtacagggaaggcctttcgggcagggcacatggttcactgccccatgacgtgataccttgaagcacaccattacagacaagtgggcccccagaatcacccgagcaggtgcttttgccccctgtccagcgtccagcacacagcatgaacttggtcaccttctgagggtgaacttgcgcacacacgtcattggaaataacatggaggtccacacactgaagtttctttggggtcaagaactcctctggttcaatgctgccccagcctgaggcgtagcaggtggtccccagtgctggctcctgggtgggcaggtccatgaccttcacagcatccgtgagctcggcaggctccgacaggcggagcagcatgaggtcgtggctggagtcatcacctggcctgaggaatcgattcttcaggaggctcatatcgtagagcgggtgtgggaagctgtggctgacctgaaatacctggcctgtgtcttcaggatgaaacangctgtgccaacccagcaagatcacgcttttggtcctgatgcaatgggcaactgtnaaggacccacttgggggtgcaccagaacaaccggccgaaaactggccttgccacgananggcccaagcaccttgccagggttgggaatgctttttnn

SEQ ID NO: 11562 - DNA, 364 bp, Homo sapiens
ggcacgaggccggctccagggccatgaagcccccaggaggagaatcgagcaatctttttggaagtccagaagaagctactccttccagcaggcctaataggatggcatctaatatttttggaccaacagaagaacctcagaacatacccaagaggacaaatcccccatggggtaaaggaagcggtatctttgacgaatcaacccccgtgcagactcgacagcacctgaacccacctggagggaagaccagcgacatttttgggtctccggtcactgccacttcacgcttggcacacccaaacaaacccaaggatcatgttttcttatgtgaaggagaagaaccaaaatcggatcttaaagctgc

SEQ ID NO: 11563 - DNA, 421 bp, Homo sapiens; identical to SEQ ID NO: 430

SEQ ID NO: 11564 - DNA, 521 bp, Homo sapiens; identical to SEQ ID NO: 3143

SEQ ID NO: 11565 - DNA, 558 bp, Homo sapiens; identical to SEQ ID NO: 3144

SEQ ID NO: 11566 - DNA, 528 bp, Homo sapiens; identical to SEQ ID NO: 3145

SEQ ID NO: 11567 - DNA, 587 bp, Homo sapiens; identical to SEQ ID NO: 3146

SEQ ID NO: 11568 - DNA, 393 bp, Homo sapiens; identical to SEQ ID NO: 432

SEQ ID NO: 11569 - DNA, 674 bp, Homo sapiens; identical to SEQ ID NO: 3148

SEQ ID NO: 11570 - DNA, 566 bp, Homo sapiens; identical to SEQ ID NO: 3149

SEQ ID NO: 11571 - DNA, 530 bp, Homo sapiens
  misc_feature 339: n = A,T,C or G
ttccgttgctgtcgctccgacaatgtggatcacattgattcccttattggctttcctgagcagattgctgaaaagctgttctctgctgctgaagccagacagaaattcactgagccaggtgcagggctgagggctttacagaaattcactgaggcctatggaagtttggtgctttgctccctgtgtttgcgaaacaggtatctcgtgatttcagaaaagcttgaggagattaagtctttccgggagctgacctgcctggatctttcctgttgcaagcttggagatgagcatgaacttctagaacatctcaccaatgaagccctgtctagtgtaactcanctccacctgaaggataattgtttatctgatgctggggtgcggaagatgacagcaccagttcgagtgatgaaaagaggccttgagaatctaacattattagacttatcatgtaaccctgagatcacagatgcaggcattggatacctcttttcttttaggaaactaaactgcttagatatctctgggacagg

SEQ ID NO: 11572 - DNA, 198 bp, Homo sapiens
aaatgaaatttatgttattatcctgctcgaagtaccattatggtttccatatggtagttacattggaaagtcctgcagtaagaatctagttctctcttttctttaagcttatggttgaaggttaaccttgtttgggcagattaccaaattactgctgatgtagtatgataaagtcagcttcttggatacagacacacc

SEQ ID NO: 11573 - DNA, 285 bp, Homo sapiens
cctgctggagtacattgcgcccatgacggagaagctctaccccggctactacaccagggcccagtttgacctggcctttgtcgtccgctacaagcctgatgagcagccctcactgatgccacaccatgatgcctccaccttcaccatcaacatcgccctgaaccgagtcggggtggattaccagggcgggggctgtcggttcctgcgctacaactgttccatccgagccccaaggaaggggtggaccctcatgcaccctggacgactcacgcattaccatgaggg

SEQ ID NO: 11574 - DNA, 359 bp, Homo sapiens
tccgttgctgtcgggccaactgcagcgtccacacagctccaccagctgaggccagcatggggacccgtgtccactgccaccaacagggccacgtcctcacaggctgcagctcccactgggaggtggaggaccttggcacccacaagccgcctgtgctgaggccacgaggtcagcccaaccagtgcgtgggccacagggaggccagcatccacgcttcctgctgccatgccccaggtctggaatgcaaagtcaaggagcatggaatcccggcccctcaggagcaggtgaccgtggcctgcgaggagggctggaccctgactggctgcagtgccctccctgggacctcccacgtcctgggg

SEQ ID NO: 11575 - DNA, 368 bp, Homo sapiens
caaaaccacaagcacgcaagtattaaataagagcaagctgtcctgagcccatacctaatgaatttgtgtcttaaatattgtacattgtgttagaggcttgtcaaaactgggattatggcaagaaaggttgcctaactcatacctttctgcctcaaattccaggtgctaaaggctaatggcattttaaacatcttacatttttaaaaatttatattgcctctgccaaacaggcctaatatttaaaagcaagttgagacaaaccaggcagattcattgtgtggaacacgaaggatgtgctttaaaaaaaggtggaatccctcaaaaaattctatatggagacagcagccttaatctacataattcttcat

SEQ ID NO: 11576 - DNA, 547 bp, Homo sapiens; identical to SEQ ID NO: 3154

SEQ ID NO: 11577 - DNA, 550 bp, Homo sapiens
atgaaggagaaataaattccatcagtttttgcttatctaggaaagactttatttctccttcatttcatcaggactagagctgaagatgaaggagacttagacacaaactcttggcctgctccaaataaagctattcctggaaagagaagtgcggttgtaatgggaagaggaagacggcgagatgacatagctcgagcttttgtgggctttgaatatgaagactctcgaggtcggagattcatgtgctctgggcctgacaaagtaatgaaagtaatgggaagtgggccaaaggaatcagctttaaaagccctaaatagtgacatgcccttatatattctgtcatcctctcaaggtagagggctgaaacctcattatgctcaacttatgaggctttttgttgtggttcctgatgctcctttgcagataatactaatgcctcaggttcagccaggcccaccaccatgtccggtattctacccagaaaaacaagaaatcacccttccacctgatggcctttgggttttgagatttccttatgcatatgtgactg

SEQ ID NO: 11578 - DNA, 506 bp, Homo sapiens
ccgttgctgtcggtcagttaaaggccactgatatttttctaagttagcaaggctcacttgcttgctttcttgcctcccttgcctccatccctctcccttcctaccttctctatttacctatttctctccctccctctcttctcctctctttttttttccccgcatatgcagctttttgattgtacttgattttatagagactgcacagttccagcaagattgggagtcaggcatggagcaggcatctcaggctaccagaaagaattggtcacctagactttcagtcaggcatcctcgtttgcattgtcctgtaagtcaattagttgataaatagttcccccttcatcccttaagttttgtttttgtttttgtttttaatataggtaagtgggactctacctaaaattttgcatcatacttatgggtaatatctttttcatatattatttatcaaagtatgaagttgagtattttgcttgtaccatttcaattctgcattatagtag

SEQ ID NO: 11579 - DNA, 574 bp, Homo sapiens
cccttcacccagagccagtgtggtcagtattccaaactctccagccactctcttctacgctgcctcaacactgaaggttgacacaggaaagtcgtactgttcatacacacagtttgagactccaagccaagagtgccacatccctatcctgtggccttttggaaatccaaattgcctgaacatggcggggctttcctgcacattctcctgatttgagattcacgggcacacctttcttttcttttcctcttgtgcctagttaagtgggaatgtgtttggagataggggaaatcacataactggtacaagtatggggtaattgcttaaacatgcctggtggaagtctgatagcgtctctgcacgtgacctctgacaaagcccatcccaggagacggggtgaagctattccccacactctcctgtgaacactggagtcttgcaagacccagggagaacccactgcttttcccaggaggctccaggattaggaaatgtgtgtatttagtgaaaaataggtttgtagtgaaatagttactatttcatgaaagtagatatttttagaatttttgaaata

SEQ ID NO: 11580 - DNA, 366 bp, Homo sapiens
agagctcaccacctacctctttggccaggacccttgaccagccaggcctgaaggaagacctgcggatggacaggagcgggcaggcccgcacatatccacttgctggagcccatgtttacagacagggacatacaccatgcagatcctgagttcctgctgtatgagcagggatatccatgcttatgtatccaaacacagagacccatgggaacaaatgagacacatatagatactgagacctgtgtgtacagtaggaccatgcactcacacccatctggagagggagcccccggtataccaagggagccagttgtgttcagacacacacatcacagcttgactcactaactgaggcctttccatagc

SEQ ID NO: 11581 - DNA, 395 bp, Homo sapiens
  misc_feature 381: n = A,T,C or G
atgtttctggtgtcagggtctgagaagttgctgccaccaactctttaagaaggcgacaggatcagtccttctctcgggttctggcccccaaggtcagagcaagcatcttcctgacagcattttgtcatctaaagtccagtgacatggttccccgtggtggcccgtggcagcccgtggcatggcgtggctcagctgtctgttgaagttgttgcaaggaaaagaggaaacatctcgggcctagttcaaacctttgcctcaaagccatcccccaccagactgcttagcgtctgagatccgcgtgaaaagtcctctgccacgagagcagggagttggggccacgcagaaatggcctcaaggggactctgctccacgtggggccangcgtgtgactgacc

SEQ ID NO: 11582 - DNA, 309 bp, Homo sapiens
tggacgctgatcagccggagcccatgcgcagcggggcgcgcgagctcgcgctcttcctgacccccgagcctggggccgaggcgaaggaggtggaggagaccatcgagggcatgctcctcaggctggaagagttttgcagcctggctgacctgatcaggagtgatacttcacagatcctggaggaaaacatcccagtccttaaggccaaactgacagaaatgcgtggcatctatgccaaagtggaccggctagaggccttcgtcaagatggttggacaccacgtcgccttcctggaagcagacgtgcttc

SEQ ID NO: 11583 - DNA, 526 bp, Homo sapiens
ggcacgagggagggcggacggaccgactgacggtagggacgggaggcgagcaagatggcgcagacgcagggcacccggaggaaagtctgttactactacgacggggatgttggaaattactattatggacaaggccacccaatgaagcctcaccgaatccgcatgactcataatttgctgctcaactatggtctctaccgaaaaatggaaatctatcgccctcacaaagccaatgctgaggagatgaccaagtaccacagcgatgactacattaaattcttgcgctccatccgtccagataacatgtcggagtacagcaagcagatgcagagattcaacgttggtgaggactgtccagtattcgatggcctgtttgagttctgtcagttgtctactggtggttctgtggcaagtgctgtgaaacttaataagcagcagacggacatcgctgtgaattgcgctgggggcctgcaccatgcaaagaagtccgaggcatctggcttctgttacgtcaatgatatcgtct

SEQ ID NO: 11584 - DNA, 449 bp, Homo sapiens
ggcacgagggaagaagcgcgaagagccgttagtcatgccggtgtggtggcggcggcggagactgcgggcccgtagctgggctctgcgaggtgcaagaaagcctttgaggtgaaggtgtatgaaagtcatcataacagatgttttccaaaaacttgtagaaggttgtgaaaaaactactacgatcacgcggcatgtattgagcatataggttgctgtagatgaatgttcttagctgtcatgtttaaaaatacttctgcttcgttacctcaagtgtggcatgcagcattttggaaggaaaattgaagacgtgttcaagaaaacatgaacagaagcaaatgatgaaaatgagcattttacttgatgttgataacatcacaataaattatggagaaaaatacatatttggctaacttttaattgctgaacaataaagtgttttcttttaaatc

SEQ ID NO: 11585 - DNA, 245 bp, Homo sapiens
aggtagggcaatgggctctgcaggccacctgactggggttggtgggggtcctctctcctgccccagctttcactcagccaccacagttgccacaccatggggtggagacgtgggtcaccactggcttgggagcaagcgccttctgcagcacacgaagccgaagctggggtcaggtgaggtcgctacccctggaggtctggcataagggccccaccctcaggtctcctacactggccccattttac

SEQ ID NO: 11586 - DNA, 261 bp, Homo sapiens
cctttaataagttttaataagttttccaaaagtttcaaaattaccaaattgtggggaaaaaataaatctgccttttaaacccaaattttaaatttttccattaaatggtttaaatccaacttcgggcaaatgccacctggaaacaccaaccccaaaatttcagaggaaatatttttccaaacaaggaaccccagggggttttttttcctttccacccccaatactggggatcataagggggctggccagttttccaaattt

SEQ ID NO: 11587 - DNA, 545 bp, Homo sapiens
tggttgcccagggaggcggcagggcgctgatcccgctggccctggaaggcacggacgtggggcagacaaaggcagcccaggcccttgccaagctcaccatcacctccaacccggagatgaccttccctggcgagcggatctatgaggtggtccggcccctcgtctccctgttgcacctcaactgctcaggcctgcagaacttcgaggcgctcatggccctaacaaacctggctgggatcagcgagaggctccggcagaagatcctgaaggagaaggctgtgcccatgatagaaggctacatgtttgaggagcatgagatgatccgccgggcagccacggagtgcatgtgtaacttggccatgagcaaggaggtgcaggacctcttcgaagcccagggcaatgaccgactgaagctgctggtgctgtacagtggagaggatgatgagctgctacagcgggcagctgccgggggcttggccatgcttacctccatgcggcccacgctctgcagccgcattccccaagtgaccacacactggctggag

SEQ ID NO: 11588 - DNA, 526 bp, Homo sapiens
tgtcctctctctgcaaattcagcttccttccccaggtctctgtgcactctgtcttggatgctctggggagctcatgggtggaggagtctccaccagagggaggctcaggggactggttgggccagggatgaatatttgagggataaaaattgtgtaagagccaaagaattggtagtagggggagaacagagaggagctgggctatgggaaatgatttgaataatggagctgggaatatggctggatatctggtactaaaaaagggtctttaagaacctacttcctaatctcttccccaatccaaaccatagctgtctgtccagtgctctcttcctgcctccagctctgccccaggctcctcctagactctgtccctgggctagggcaggggaggagggagagcagggttgggggagaggctgaggagagtgtgacatgtggggagaggaccagctgggtgcttgggcattgacagaatgatggttgttttgtatcatttgattaataaaaaaaaatgaaaaaagtg

SEQ ID NO: 11589 - DNA, 732 bp, Homo sapiens
  misc_feature 137, 176, 332, 517, 600, 629, 658, 680, 710: n = A,T,C or G
ccgcagtcttcgccaccatgccgccctacaccgtggtctatttcccagttcgaggccgctgcgcggccctgcgcatgctgctggcagatcagggccagagctggaaggaggaggtggtgaccgtggagacgtggcangagggctcactcaaagcctcctgcctatacgggcagctncccaagttccaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacatntccctcatctacaccaactatgaggcgggcaaggatgactatgtgaaggcactgcccgggcaactgaagccttttgagaccctgctgttccagaaccagggaggcaagaccttcattgtgggagaccagatctccttcgctgactacaacctgctggacttgctgctgatccatgaggtcctagnccctggctgcctggatgcgttccccctgctctcaccatatgtggggcgccttaagtgcccggcccaaagctcaaagggctttnctggccttccctgagtacgttgaaccctncccatcaatggcaaccggggaaacaaacnaagggttgggggggactttganccgggaaggcagaaatttggccttcttttnttcaagaaccaataaaaatttt

SEQ ID NO: 11590 - DNA, 615 bp, Homo sapiens
gctgtcaaaaatgctattgatgatggctgtgtggttccaggtgctggtgccgtggaagtggcaatggcagaagccctgattaaacataagcccagtgtaaagggcagggcacagcttggagtccaagcatttgctgatgcattgctcattattcccaaggttcttgctcagaactctggttttgaccttcaggaaacattagttaaaattcaagcagaacattcagaatcaggtcagcttgtgggtgtggacctgaacacaggtgagccaatggtggcagcagaagtaggcgtatgggataactattgtgtaaagaaacagcttcttcactcctgcactgtgattgccaccaacattctcttggttgatgagatcatgcgagctggaatgtcttctctgaaaggttgaattgaagcttcctctgtatctgaatcttgaagactgcaaagtgatcctgaggattacagctgtggaatttttgtccaagcttcaaataattttgaaagaaattttcccatatgaaaaaaggagagaacactggcatctgttgaaatttggaagttctgaaattatagtatttttaaaaattgcactgaagtgtatacacataaagca

SEQ ID NO: 11591 - DNA, 602 bp, Homo sapiens
ggcacgagctctattcagagcataccagaaattcctgatgacctgaagcaactttataaaactgtgtgggaaatctctcagaaaactgttctcaagatggcagctgagagaggtgctttcattgatcaaagccaatctttgaacatccacattgctgagcctaactatggcaaactcactagtatgcacttctacggctggaagcagggtttgaagactgggatgtattatttaaggacgagaccagcagctaatccaatccagttcactctaaataaggagaagctaaaagataaagaaaaggtatcaaaagaggaagaagagaaggagaggaacacagcagccatggtgtgctctttggagaatagagatgaatgtctgatgtgtggatcctgaggaaagacttggaagagaccagcatgtcttcagtagccaaactacttcttgagcatagataggtatagtgggtttgcttgaggtggtaaggctttgctggaccctgttgcaggcaaaaggagtaattgatttaaagtactgttaatgatgttaatgatttttttttaaactcatatattgggattttcaccaaaataatgcttttg

SEQ ID NO: 11592 - DNA, 489 bp, Homo sapiens
tgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagttgaggagaagaaagtggaagcaaagaaagaagaatccgaggagtctgatgatgacatgggctttggtctttttgactaaacctcttttataacatgttcaataaaaagctgaacttt

SEQ ID NO: 11593 - DNA, 569 bp, Homo sapiens; identical to SEQ ID NO: 3165

SEQ ID NO: 11594 - DNA, 767 bp, Homo sapiens
  misc_feature 39, 46, 256, 436, 438, 456, 593, 601, 627, 640, 644, 676,684, 714, 727: n = A,T,C or G
tggtaactcacgtagtgctccacctacacgagggccccnttttttnttatggtggaagcagtcgctatgatgattacagcagctcacgtgacggatatggtggaagtcgagacagttactcaagcagccgaagtgatctctactcaagtggtcgtgatcgggttggcagacaagaaagagggcttcccccttctatggaaagggggtaccctcctccacgtgattcctacagcagttcaagccgcggagcaccaanaggtggtggccgtggaggaagccgatctgatagagggggaggcagaagcagatactagaaacaaacaaaactttggaccaaaatcccagttcaaagaaacaaaaagtggaaactattctatcataactacccaaggactactaaaaggaaaaattgtgttactttttttaaattccctgntnagttcccctccataaatnttatgttcttgtgaggaaaaaagtaaaacatgtttaattttatttgactttcgcattgcttttcaacaagcaaatggtaaatgtgttaagacttgtactagtggtgtaactttccaagtaaaaagtatcccctaaangccacttnctatctgattttttccagcaaatgangcaggcaattctnaaanctttccccaaaacatctagcccatctaaaaanggagagangaatcaattctacctatccaaacaagctancttttaaaagggngggtggggggatgctactcataaaaaattcaagggggctt

SEQ ID NO: 11595 - DNA, 63 bp, Homo sapiens
ctgggcaagtactggcctggcacccgcagccgtctccctttcgtggaccaaggaggtgtttgc

SEQ ID NO: 11596 - DNA, 53 bp, Homo sapiens
actatagggctttttttttttggccaaaaaaattttttatttttaaaccccgg

SEQ ID NO: 11597 - DNA, 357 bp, Homo sapiens
ggcttagcggataacaatttcacacaggataagactagcccccatctcaatcatataccaaatctctccctcactaaacgtaagccttctcctcactctctcaatcttatccatcatagcaggcagttgaggtggattaaaccaaacccagctacgcaaaatcttagcatactcctcaattacccacataggatgaataatagcagttctaccgtacaaccctaacataaccattcttaatttaactatttatattatcctaactactaccgcattcctactactcaacttaaactccagcaccacgaccctactactatctcgcacctgaaacaagctaacatgactaacaccctt

SEQ ID NO: 11598 - DNA, 625 bp, Homo sapiens; identical to SEQ ID NO: 2759

SEQ ID NO: 11599 - DNA, 638 bp, Homo sapiens; identical to SEQ ID NO: 2757
  misc_feature 522, 634, 636: n = A,T,C or G

SEQ ID NO: 11600 - DNA, 544 bp, Homo sapiens; identical to SEQ ID NO: 3167

SEQ ID NO: 11601 - DNA, 506 bp, Homo sapiens; identical to SEQ ID NO: 3169

SEQ ID NO: 11602 - DNA, 111 bp, Homo sapiens
ggacctgacccacactgaatgtagtctttcagtacaagacaaagtttcttaaatcccgaagagaaatataagtgttccacaagtttcacaattctcattcaagtccttact

SEQ ID NO: 11603 - DNA, 490 bp, Homo sapiens
ttgctgtcggtgaagggatgttttttttgtaatgctgcagtaaagttggagtacttagttctcttgttgtccagtatatctaataagtgtttttcatattatttccacgtaagggaaataaggtagtacttttctttttatatttctatgcttaaaattctctttcctagtcaaaaattgcccaaatctgtgtttgctttctgcttgctacatttgtctcccttacttttcttgagctaaagacaggctttttccaccggcatcatcactgctatcatcattaacagcgtaattatacaagcatatttaatgctgagtttaatttaatatgtaatacatatggtaattgtagggtaatacccacaacaactgtagtttcttacttggccaagagaatgcttatttaagtgttagacttccattctggcaaaatcttgccttatcagaagacattggaaagagggattccctttggtgtttggtcttctac

SEQ ID NO: 11604 - DNA, 380 bp, Homo sapiens
cgttgctgtcgggcttgggcagcaacccctgcattcctttttttttaccgggctgacgagaatgatgaggtgaagatcactgtcatctaaaagccggctactgtcagcaaagcctgaagaagtggggctggataccctgcccccaccatatccctaccatcccttctcagtcaaccctttacccttacagtagcaagcatagacccctgtctaacgggggtagacaggtgcagatgaggtgaagatcactgtcatctaaaagctggccactaaattaaaaaaaaattaaaagttatgggattaaaaaaagttatgggataaaaaaggttatgggtaacttatggtataaaagttatgaaaaaaggccaggtgcagtggct

SEQ ID NO: 11605 - DNA, 606 bp, Homo sapiens; identical to SEQ ID NO: 3171

SEQ ID NO: 11606 - DNA, 416 bp, Homo sapiens
cgttgctgtcgtcccttgttggagggaatagagtgggggtgggactctgcaggggtgtccttgtccactcgcacccctcgccgcccaccagggccatgctctgtgacttgggctgatccccaccctttctgggcctacagcaccacaggccgctgtacccccttagagctgcccctctctggcctggccggcagacgtcttcttaactcctctgtcctctatattcagcatgttccttgtcagctgctgggccggccctgccttgcgctagcagagcctctcctggcagcttctcaggtctccctaatggagacaccaggctactaggacactggctggggccaccccctcctgcctaatgcctcaccttacagctggggaaactgaggcctggaatggcccaaagtcaccaaggg

SEQ ID NO: 11607 - DNA, 582 bp, Homo sapiens
aattccgttgctgtcgggctaggcaggcgcggacgctccgtcccgacctcacgcgtgacactgtgagggccagacgccagcccccgcgccgccccctgtgcctttgaggttgggcccgttctcagactccatctccggccgggccgcgcgccccgcgccctcgtgggctggtgtctcgcagctggagctggtgagcaggctgctgcacctgcacttcaaggatgacaagaccaaagaagcagcagtccgcggcgtgcggcaggcccaggcagaagacgcgctccgtgtggacgtggaccagctggagaaggtgcttccgcagctgctcctggacttctagggatctcagccgtggctgaggccacccccagaggagcccctggtccacagaagcaggccttgtgtttccagcggcctctgataagaggcagggaaggacctgaaggatttggagttgattcaaacaagatctctgggagtctccagcctgtgcagaaggggcaggactgcagtgcactgcgggccttggagtgtccagtggggacactggtgtgggaaggggcagcacctggggagtccctg

SEQ ID NO: 11608 - DNA, 444 bp, Homo sapiens
gcattttgtgcacacaaaatgtgcgcacacacacacacacacacacacagacactcctgcacatggcctgttaaagaactacaagggaggtgggacgcgggaaagtgtatggtgtgggtttgcatcgtctcatcattgattcttctcatatttttctctgattagagaaactaaagagaattttgtgagaaaggcttgaaagttaatgagttacttctaccaaagtgattacaagcagaaatcctcagatgctgtagagatgctgacccacacatccttagctcaaggaagcccctcgcattagtcaccttcagccatcagcagcctccaccattaaccccagtgtgctgtataaaaaatactttctacatgtgcccaaatttgaaaagttaggaagcactgatttcaaagcaaatcattcacatttgaactgtcttcagtgta

SEQ ID NO: 11609 - DNA, 528 bp, Homo sapiens; identical to SEQ ID NO: 3175

SEQ ID NO: 11610 - DNA, 672 bp, Homo sapiens
  misc_feature 209, 642, 658, 663: n = A,T,C or G
ggcacgagcccaggcaggtccctttgccggcccctacaggctggggtggcccctcctgtcctcagggatcagactcccagactggttagttctgcatgtttccatcaaattaaaggttattccctggccgcctcctggagaaaaccaaccccaccctgccagctgggggcaatggggcagggattttggcctctcagaacagctcctanaggctgctcatgactgaatgttttcccaaatcacctaaatatcggtttgctttttgttttgggggagaggatttagcctcttacttccctgatggattcaaagttttatctatctccttatctcctgccctgtcttggcacaactctggatagattgcaggtgtggaatttgctggagtttggtgacttcgtcaaattcctttggattctgttccgccaaatcagcagtctcgtcctgtggatgcagtgactggaatttcccatctgcaaagcatctctgtagcccagattttgtggagccttaagacactccctcaatgccaccctgacccacggctggagaaccctgtgcttatgtggtgggcaaggccactgttgatggaaggatggcggggacggggttggtgcttcaaaggatctgtggtgcttggangtctacacccttttangacancgtgtcaag

SEQ ID NO: 11611 - DNA, 674 bp, Homo sapiens
  misc_feature 455, 499, 633: n = A,T,C or G
ggcacgagggaacaagtagttttcaaaattgagctcctccaaggtcattggccaatgctgtgtgcaggcattggtcatctttgtaaactcatggcattatttcctcatatgcattatgatactaagaaattcaaccccaacctgtatgaaaagcacagcccagggccctaattgaggctagcatgaatgcctttgaggggccagggggccataggaggcccatgcaatttaactgaagctcaggtgccacgttggatttttattcttattaggccgcaacctttctgaatgagtttagggcaggggctgctgatccggctgtggattcagggagctctaaaatgaatctctaccgttcctttaaaggtctttctggttcctcccagtgttgtcattgctgaggtcgatctcgtagttgttcagttgtgctctttttgctgtcttgtgagtcttanccagtgatccagctgcccaaggacagggccttcagagggcctancgcccttctggtaccaagcgtgtgctcctggcctgtgtgacagtgtctttcccgaagcagtgaaatgagaaattctgcaagtggccaccccggaagatcagtctgtagctcttgggcctggatttctactatgntagtgaatgtaggaatatactgggctttaatggatgaaaat

SEQ ID NO: 11612 - DNA, 495 bp, Homo sapiens
aattccgttgctgtcggtggaagcggcactcaagatgctgcgccgcgaggcccgcctgcgccgcgagtacctgtaccgcaaggcccgggaggaggcgcagcgctcagcccaggagaggaaggagcggctgcggcgcgcgctggaagaaaaccgcctgattcccactgagttacgccgagaggctctggccttacaggggtccctggagtttgatgatgctggaggtgaaggtgtgaccagccacgtggatgatgaataccgatgggcaggagtcgaggatcccaaggttatgatcactacctcccgagaccccagttcccgcctcaagatgtttgcataggagctgaagctggtgttcccgggcgcccagcgaatgaaccgaggtcgacatgaagtgggggcactggtgcgagcctgcaaagccaacggcgtcaccgatctgctggtcgttcacgagcatcggggcacacctgtggggctcatcgtcagccacct

SEQ ID NO: 11613 - DNA, 544 bp, Homo sapiens
ttagattcctggaaaagtacaaagattcagcccagagggatgacatgatttttgaagattgtggcgatgtgcccagtgaaccgaaagaacgaggagactttaatcatgaacgaggagagcgaaaggtctgcagattcaagcttgaatggctgggaaattgctctggattaaatgatgaaacttatggctacaaagagggcaaaccgtgcattattataaagctcaaccgagttctaggcttcaaacctaagcctcccaagaatgagtccttggagacttacccagtgatgaagtataacccaaatgtccttcccgttcagtgcactggcaagcgagatgaagataaggataaagttggaaatgtggagtattttggactgggcaactcccctggttttcctctgcagtattatccgtactatggcaaactcctgcagcccaaatacctgcagcccctgctggccgtacagttcaccaatcttaccatggacactgaaattcgcatagagtgtaaggcgtacggtgagaacattgggtacagtga

SEQ ID NO: 11614 - DNA, 499 bp, Homo sapiens
aattccgttgctgtcgggtggagccatccctgggcaggctccagggtctgtgccaggcccagggctggtgaaggactcaccactgctgcttcagcagatctctgccatgaggctgcacatctcccagctccagcatgagaacagcatcctcaagggagcccagatgaaggcatccttggcatccctgccccctctgcatgttgcaaagctatcccatgagggccctggcagtgagttaccagctggagcgctgtatcgtaagaccagccagctgctggagacattgaatcaattgagcacacacacgcacgtagtagacatcactcgcaccagccctgctgccaagagcccgtcggcccaacttatggagcaagtggctcagcttaagtccctgagtgacaccgtcgagaagctcaaggatgaggtcctcaaggagacagtatctcagcgccctggagccacagtacccactgactttgccaccttcccttcatcagcc

SEQ ID NO: 11615 - DNA, 349 bp, Homo sapiens
ccgttgctgtcggctctccagttcccagggagtggtactaacagcctaccaccccagcggcaaggaccaggccgtcgggaacagccatgcaaaggcaggggaggaagccacctcgagtcgcagatatggccagtacactatgaaccaggaaagcaccaccatcaaagttatggagaagcctccatttgatcgatcaatttcccaggattctttggatgaactatctatggaagactattggatagaactagaaaacatcaagaaatctagtgaaaacagccaagaagatcaagaggtggttgttgtcaaagagcctgatgagggagaattggaagaagagtggcttaaa

SEQ ID NO: 11616 - DNA, 475 bp, Homo sapiens; identical to SEQ ID NO: 3181

SEQ ID NO: 11617 - DNA, 531 bp, Homo sapiens
tttcaaaaaattgttgcatgtttttgatgcaatttgggaaattgtttacttcacaatgtagtcattcataaaaaaattcatgaaaatactgaacatatgtttgaggatttttcttttcctttttaaatttttttattttttctgagacggagatctgctcttacgcccaggctagagtgaagtggcgcgatcttggcttactgcaacctccaccccccaggttcaagcgattctcctgcctcagcctccggagtagctgggattacaggcgcccgccaccacgtccggctaatttttgtattttcagtagagacggggttttgctatgttggccaggctggtctcaaactcctgacctcaagtgatccacctgcctcggcctcccaaagtgttaggataacaggtgtgagccaccgtgcccggctgaagatttttcttaattgcaataaatattcagcattttttctaatgaaaatgaattttgtttaccagtaaaagtatgcattttaaaagactttcagatttatgctt

SEQ ID NO: 11618 - DNA, 63 bp, Homo sapiens
tgtggagtgaaagctcacaaatttggcttctaaagggaagctgttgacacagaaagcctaggg

SEQ ID NO: 11619 - DNA, 456 bp, Homo sapiens
ctaaaaaaaaaatcacattgtacaaatttagatagaacattatcaatgctcagatttataaaaatgggaacagaaagactaaagctagcgaaggaacgtacatttctgttttgtctttttaaattaggaaggtaaaagtgattttttcttcaggtgcagtgatagtaaatgtctagaagacatccgaagagccagaaataaaaagcacaggagccgcctgcagactctcagagttctgtcttcacccactgaatccgaagtggatgcgtgtggcgctcccgcagggtggcctggccccgtggatccacgccgaacgctcaacgagattcccaaggctggctgtgtacagcctaaaactttgtgctcagagaaaaaccagcatgatgggttcatcaactcctgtttctcaaacaaaatgagttttctgtacacttgttacaaaggtctgtacaaaag

SEQ ID NO: 11620 - DNA, 452 bp, Homo sapiens; identical to SEQ ID NO: 3183

SEQ ID NO: 11621 - DNA, 559 bp, Homo sapiens
ccgttgctgtcggtccgccatattgatggagaatactcctgggtctgaaaaccatgaagacatagagcttctgcagaaactctataaaacaggtcgggagatgcaggagaggatcatggacctgcttgtggtggtggagaacgaagatgtaactgttgagctaattcaggtgaatgaggatttgaataatgctatccttggatatgagaggtttactagaaaccaacaaaggattttggagcaaaataagaaccagaaggaagccaccaatactaccagtgagccttctgccccatctcaagatctcctcgacctaagtcccagtccccggatgcctagggccactctgggagaactcaacaccatgaataatcaactttcaggcttaaatttcagccttccaagttctgatgtaacaaacaacttaaaacccagtcttcatccacagatgaacttgctagccttggagaatacagagatacccccgtttgcccaaaggaccagccaaaacctcacctcaagccacgcatatgataattttctggaacattcaaattca

SEQ ID NO: 11622 - DNA, 518 bp, Homo sapiens; identical to SEQ ID NO: 3187

SEQ ID NO: 11623 - DNA, 539 bp, Homo sapiens; identical to SEQ ID NO: 3188

SEQ ID NO: 11624 - DNA, 348 bp, Homo sapiens
ttccgttgctgtcgtgggggagggggaaatacagggatggtccatgttttcaagagtaggggaatgatgtttaaacacaaaaataaattttttttcatttccagaaacactatttatttatggttttttttttttaattttttcttttggggggtgaaattggcagatgcctgaggtcatagctgtgtcctgggtcactggggctggggaggacctcaaggaccccatcaagtgtacacagcagcagcaaaatcaagggatgaccctcctttggggccccctgtcctcagcacattccaggcagttgtgccctgacccacagggacccgtggggatgggaggaggtcc

SEQ ID NO: 11625 - DNA, 308 bp, Homo sapiens
gaaagaatgaaagaattgagtcaggacagtactgggcgggtgaaacgattaccacccatagtgcgaggaggagccatcgacagatactggcccaccgccgacgggcgcctggttgaatatgacatagatgaagtggtatatgacgaagattcaccttatcaaaatataaaaattctacactcgaacagtttggaaatattctcatccttagtggggatgttaatttggcagagagtgatttggcatatacccgggccatcatgggcagtggcaaagaagattacactggcaaagatgtactcattctg

SEQ ID NO: 11626 - DNA, 407 bp, Homo sapiens
ctcaggtttaacttgcacagagcaaaattttatatcaaaatctggttatcatcagtctgcttcagaacatggtcttgttgtcattgctccagataccagccctcgtggctgcaatattaaaggtgaagatgagagctgggactttggcactggtgctggattttatgttgatgccactgaagatccttggaaaaccaactacagaatgtactcttatgtcacagaggagcttccccaactcataaatgccaattttccagtggatccccaaaggatgtctatttttggccactccatgggaggtcatggagctctgatctgtgctttgaaaaatcctggaaaatacaaatctgtgtcagcatttgctccaatttgcaaccctgtactctgtccctggggcaaaaaag

SEQ ID NO: 11627 - DNA, 467 bp, Homo sapiens
ctgagtcctggtgccagaagctgaaccagcgcaaggagaacctctccaggcgggaacgggagcaccacgcggaggccgcgcagttccaggaagatgtcaacgccgatcccgaggtgcagcgctgctccagctggcgggagtacaaggagctgctgcagcggcggcaggtgcagaggagccagcgccgggcccctcacctgtggggccagcccgtcaccccgctgctgagtcctggccaggccagctccccagccgtggtccttcagcatatctctgtgctgcagacaacacaccttcctgatggaggtgtccggctgttggagaagtctgggggcttggaaatcatctttgatgtttaccaggccgacgctgtggccacattccgaaagaataaccctggcaaaccctatgcccggatgtgcattagtggatttgatgagcctgtcccagacctctgcagcctcaag

SEQ ID NO: 11628 - DNA, 593 bp, Homo sapiens
tttaatcccagcactttgggaggctgaggcagatggatcgcctgaggttgggagttcgagaccagcctggccagcatggtgaaaccctgtctctactaaaaatacaaaaattagccaggtgtggtggcgcacacctgtagtcccagctactcgggaggctgaggcaggagaattggttgaacccaggaggcggaggttgcagtgagcagagatcgtgccactgcactccagcctgggtggacagagcaagactccgtctcaaagaaacaaacaaaaaattaaaagggatagaatataatgaaatatattttgaacttaaattatattctatatgtgtatcttcctaggcaaaagctgtaatttccagagagaccattaggaacagggagtatctatttttctccattatttatttctagaaactcataaaatggattgtatttttctataagaacaaaatattaattaaggtatagatgactgaccaagggcttaatcaaataaaatgactaacagcatctatcataaagccacacaagccttatgttctcatctcaaaaatgctgtgacagctttttggctgctttaaccat

SEQ ID NO: 11629 - DNA, 481 bp, Homo sapiens
accatggcggacggcggctcggagcgggctgacgggcgcatcgtcaagatggaggtggactacagcgccacggtggatcagcgcctacccgagtgtgcgaagctagccaaggaaggaagacttcaagaagtcattgaaacccttctctctctggaaaagcagactcggctgcttccgatatggtatcgacatcccgtatcttacttgcagtagtgaagatgtgctatgaggctaaagaatgggatttacttaatgaaaatattatgcttttgtccaaaaggcggagtcagttaaaacaagctgttgccaaaatggttcaacagtgctgtacttatgttgaggaaatcacagaccttcctatcaaacttcgattaattgatactctacgaatggttaccgaaggcaagatttatgttgaaattgagcgtgcgcgactgactaaaacattagcaactataaaagaacaaaatggtgatgtgaa

SEQ ID NO: 11630 - DNA, 436 bp, Homo sapiens; identical to SEQ ID NO: 3189

SEQ ID NO: 11631 - DNA, 439 bp, Homo sapiens
acatctgttgtcaactgctgtacccagaaatctagaactctgccgacagcctctcctggtgagtcgggactcagctgaggacacatccccaccctgcctcccatctggccctttggacaactggccctttgtgacagggctgactcaagtgttaggcagggtctcaggcctttgattgctcacccctgctccccaggccctgccctcacttttaccaaaggttctccctcggcgggagggcatctgtgttggaggtgatttgtctgggttcttccttttggttccagaaggaactgtcagtcatcagcatctgcgttgttagcagtcagtaccacccccgccccacaatgacagtcaaggctgacttgttgactgaagcctttttcccagaccccttatttcgaatccccaagcttcagtccctcttgggggtggagac

SEQ ID NO: 11632 - DNA, 432 bp, Homo sapiens
gcctggtgctgcctatggctctggagctcatgacggtgctggtgggcagcccccgcaaggatgggctggtgtctctcctcaccacctctgagggtgccgatgagccccagcggctgcagtttccactgcccacagcccagcgctcgctggagcctgggactcctcggtgggccaactatgtcaagggagtgattcagtactacccagctgcccccctccctggcttcagtgcagtggtggtcagctcagtgcccctggggggtggcctgtccagctcagcatccttggaagtggccacgtacaccttcctccagcagctctgtccagactcgggcacaatagctgcccgcgcccaggtgtgtcagcaggccgagcacagcttcgcagggatgccctgtggcatcatggaccacttcatctcacttatgggac

SEQ ID NO: 11633 - DNA, 262 bp, Homo sapiens
ggggtttggagactggcgggcctcggaacagcagagctagcggacttccggtctggccctccgctcacggccgagggcaaggcgggttaggtcacttgctgaggaaagagctcaatatgtcacgtgttcctctcccaatgacgtggacctcagttccctctccagtgaagtgggcacagtgttgcccgaaaaagggtgctctggggcttgcctgagacgggacgcgtggaaatgccctgccgaatatgaatggggcgatggc

SEQ ID NO: 11634 - DNA, 524 bp, Homo sapiens; identical to SEQ ID NO: 3190

SEQ ID NO: 11635 - DNA, 595 bp, Homo sapiens
caactcatggaggggtcttcaaagaccttgcaagaagtactaactatggagtatcggctaagtcaagcttgtatgagaggtcatgactttcatgaaggcgttagagctgttttaattgataaagaccagagtccaaaatggaaaccagctgatctaaaagaagttactgaggaagatttgaataatcactttaagtctttgggaagcagtgatttgaaattttgaggtgacaggcttttaaggtatattttgtagcatgggttggcaatctacagcatgtgggccaaatccagcctgctgcctgtttttatataccctgtaagctaagaatggtttccgcatttttaaatggttgggaaaagaaatcaaagactaataattcatgacgtgaaaattatcagaattcacaaataaagctttattggaactagctatactcatctgtttatatattatctgtggctgctttgaaatgagtagttgcaatagagatggtaaagcctacaaagcctaattatttactgtctggtttttgtcagaaaaaagtttgtcaatccttgttttagaagatggaaaaatgtgaagatctttggag

SEQ ID NO: 11636 - DNA, 423 bp, Homo sapiens
ggcacgaggcgaggctggcttcgccgagtatgtgggccgcctgggcatcagcaaccacacgcacgtggtggtgtatgatggtgaacacctgggcagcttctatgctccccgggtctggtggatgttccgtgtgtttggccaccgcaccgtatcagtgctcaatggtggcttccggaactggctgaaggagggccacccggtgacatccgagccctcacgcccagaaccggccgtcttcaaagccacactggaccgctccctgctcaagacctacgagcaggtgctggagaaccttgaatctaagaggttccagctggtggattcaaggtctcaagggcggttcctgggcaccgagccggagccggatgcagtaggactggactcgggccatatccgtggtgccgtcaacatgcctttcatgga

SEQ ID NO: 11637 - DNA, 532 bp, Homo sapiens
ggcacgaggcccagtcgccgcgggaccggggccgctggggtctggacgggggtcgccatgatccgctttatcctcatccagaaccgggcaggcaagacgcgcctggccaagtggtacatgcagtttgatgatgatgagaaacagaagctgatcgaggaggtgcatgccgtggtcaccgtccgagacgccaaacacaccaactttgtggagttccggaactttaagatcatttaccgccgctatgctggcctctacttctgcatctgtgtggatgtcaatgacaacaacctggcttacctggaggccattcacaacttcgtggaggtcttaaacgaatatttccacaatgtctgtgaactggacctggtgttcaacttctacaaggtttacacggtcgtggacgagatgttcctggctggcgaaatccgagagaccagccagacgaaggtgctgaaacagctgctgatgctacagtccctggagtgagggcaggcgagccccaccccggccccggcccctcctggactcgcct

SEQ ID NO: 11638 - DNA, 459 bp, Homo sapiens; identical to SEQ ID NO: 458

SEQ ID NO: 11639 - DNA, 562 bp, Homo sapiens
caaattaccagtctgcattcactgaatgccttcttgctgccaattaaaactgtaggtgtgcagggtgactgtcgttcctacagttacgtgtgtggaatctccagtaaagatgaacctgactgggaatcacttatttttctggctaggcttatacctcgcatgtgtcacaacgttaacagagttgtttatatatttggcccaccagttaaagaacctcctacagatgttactcccactttcttgacaacaggggtgctcagtactttacgccaagctgattttgaggcccataacattctcagggagtctgggtatgctgggaaaatcagccagatgccggtgattttgacaccattacattttgatcgggacccacttcaaaagcagccttcatgccagagatctgtggttattcgaacctttattactagtgacttcatgactggtatacctgcaacacctggcaatgagatccctgtagaggtggtattaaagatggtcactgagattaagaagattcctggtatttctcgaattatgtatgacttaacatcaaagcccc

SEQ ID NO: 11640 - DNA, 495 bp, Homo sapiens
ggcttagcggataacaatttcacacaggagctagcagaccagagaagggctacatatggactcatgttgggcctactcctgcaataacaattaaggaatcagttgccaaccatttgtagttcacaaattaaaactgggtttccaggcctggtgtggtggctcacgcctgtagccccagctattgcaccactgctctccaagctgggcaatggagtcagattctctttcttaaaaaaccacaaaaaaactggatttccagttctctaatattcttagtaccacaagatatgtcataggtatctttaaatgaaattcttagctggaaaagtgactaaaaattttttctcctgctacctagtaataaacaaatcattgtttattactggtcacttagaaaattaaaagggatagggccaggcacagtggcttatgcctgtaattgcagcacttttagaggccgaggcaggcggatcacctgaggtcgggaagtggatc

SEQ ID NO: 11641 - DNA, 146 bp, Homo sapiens
cgggggaaggccctttgtaaagtaggccttatttctcttgtcctttcgtacagggaggaatttgaagtaaataaaaaccgacctggattactccggtctgaactcaaatcacgtaggactttaatcgttgaacaaacaaaccttta

SEQ ID NO: 11642 - DNA, 248 bp, Homo sapiens
ggcttagcggataacaatttcacacaggatggattggtcctagcctttctattagctcttagtaagattacacatgcaagcatccccgttccagtgagttcaccctctaaatcaccacgatcaaaagggacaagcatcaagcacgcagcaatgcagctcaaaacgcttagcctagccacacccccacgggaaacagcagtgattaacctttagcaataaacgaaagtttaactaagctatactaaccc

SEQ ID NO: 11643 - DNA, 361 bp, Homo sapiens
actatagggcttttttttttattcgagatggagtcttcttgctctgttgcccaggctggagtgcagtggtgccatcttggctcactgcaacctccgcctcctgggctcaagcgattctgcctcagcctcccgagtagctgggattacaggcatgtgctaccattcctggctaatttttgtacttttagtaaagacagggttttgccatgttggccaggctggtctcgaacttccgacctcaagtgatccacccactttggcctcccaaagtgctgggatgacgggtgagccactgcacctggccaagagggctgatagtaaattattgcaagtgaaaaaactaacgatgcaaatgaaaggg

SEQ ID NO: 11644 - DNA, 382 bp, Homo sapiens
ctgtcggtcctaatgtgtcagcagcaaatccccgaggtgtcttcatgatgtgcatcccaccccccaatgtgacaggctccctgcacctgggccatgcactcaccaacgccatccaggactccctgactcgatggcaccgcatgcgtggggagaccaccctgtggaaccctggctgtgaccatgcaggtattgccacccaggtggtggtggagaagaagctatggcgtgagcagggactgagccggcaccagctgggccgcgaggcctttctacaggaagtctggaagtggaaggaggagaaaggtgaccggatttaccaccagttgaagaagcttggcagctccttggactgggatcgagcctgtttcaccatggaccctaa

SEQ ID NO: 11645 - DNA, 300 bp, Homo sapiens
atgacactgaaattccccataagggtgtgattgtatattcagccaagacactgtatctcccttatgccttttattttcctgacatagcatgctgctggatcaatgtgtgtattgttgctactctgcctatgccagaggtggtgactcactcacacatataaataattttagttgaatgtttttataggttgtgtattccttacttgaaaggcttgggaccagaagtgttgcagatttcagatatttttagattttggaatatttgcattatacttaccagttgagcatcccacaaacctg

SEQ ID NO: 11646 - DNA, 435 bp, Homo sapiens
ccgttgctgtcggcgtggttagcgtcggcggcttttggcatggcgactttttctggcccggctgggccaatcctgtcgcttaatccgcaggaagatgtcgagtttcaaaaggaggtggcgcaggttcgcaagcgcataacccagcgaaaaaaacaagaacaacttactcctggagtagtctatgtgcgccacctacctaacctacttgacgaaacccagatcttttcatatttctcccagtttggcactgtgacacggttcaggctgtccagaagtaaaaggactggaaatagcaaaggctatgcatttgtggagtttgagtctgaggatgttgccaaaatagttgctgaaacaatgaacaactacctgtttggtgaaagactcttggagtgtcattttatgccacctgaaaaagtacataaagaactctttaaa

SEQ ID NO: 11647 - DNA, 530 bp, Homo sapiens; identical to SEQ ID NO: 3194

SEQ ID NO: 11648 - DNA, 514 bp, Homo sapiens
ttccgttgctgtcgggaggacggcgagagcacggacagactcatggggaagggccaggtccagctggacccgcaggccctgcaggacagagactggcagcgcaccgtcatcgccatgaatgggatcgaagtaaagctctcggtcaagttcaacagcagggagttcagcttgaagaggatgccgtcccgaaaacagacaggggtcttcggagtcaagattgctgtggtcaccaagagagagaggtccaaggtgccctacatcgtgcgccagtgcgtggaggagatcgagcgccgaggcatggaggaggtgggcatctaccgcgtgtccggtgtggccacggacatccaggcactgaaggcagccttcgacgtcaataacaaggacgtgtcggtgatgatgagcgagatggacgtgaacgccatcgcaggcaccctgaagctgtacttccgtgagctgcccgagcccctcttcactgacgagttctaccccaacttcgcagagggcatcgctcttt

SEQ ID NO: 11649 - DNA, 565 bp, Homo sapiens
aattccgttgctgtcgatcaaggactgtccttggtatgaccgtggcttctgcaagcacggtcccctctgcaggcaccggcacacacggagagtcatctgtgtgaattacctcgtgggattctgcccggaggggccctcgtgtaaattcatgcaccctcgatttgaactgcccatgggaaccaccgagcagcccccactgccgcagcagacacagcctccagcaaagcaaagtaacaatccgccattacaaaggtcgtcctccttgatccagttaacgagtcagaactcttctcccaatcagcagagaaccccgcaggtcatcggggtcatgcagagtcaaaacagcagcgcgggcaaccggggaccccggccactggagcaggtcacctgttacaagtgtggcgagaaaggacactacgccaacagatgcaccaaagggcacttggcctttctcagtggacagtgacagcagctggagccagctccgagcagcccgggggccccgctgttgggagtgtgcatttaactgtttcatgcgcttgttggcgcgactgtggctcgagct

SEQ ID NO: 11650 - DNA, 600 bp, Homo sapiens
cgttgctgtcggcggcccggggcgactgagcggacaaacggaagtgtaggttacgggtctgagacatcaccgccaagctgggcatcggggagatggccgagactgaccccaagaccgtgcaggacctcacctcggtggtgcagacactcctgcagcagatgcaagataaatttcagaccatgtctgaccagatcattgggagaattgatgatatgagtagtcgcattgatgatctggaaaagaatatcgcggacctcatgacacaggctggggtggaagaactggaaagtgaaaacaagatacctgccacgcaaaagagttgaaggttgctaataatttatactggaatctggcatttttccaagccaagagaagatcgaatggctttttgcagctaactactatgtgtagacaggttttatattataaagtatgcattcttatcacctagtatatagttagtttgtagagtgatttccccccagtttcttgaacatggtatcttcacatcttggaccttggtcagttgtgctattcattattaaacactaaaactttggcggttcttgcataacattgtcagatttttagtgtatttct

SEQ ID NO: 11651 - DNA, 146 bp, Homo sapiens
aaaaacccaaaaatttttttttgggggcccggtttttaatttgaaacccccctcctttaggggccccccttaaaattaaaaatttcttaaaaagcccctttaaacccaaaaaaaaggggggaaccgggccccatttggggttttga

SEQ ID NO: 11652 - DNA, 477 bp, Homo sapiens
agcgctgtctagaagacccacacgccctcctccagcagctgaattcctgcagctcaccatccgccgccagagcaggacgaaccgccaatcgcaaggcacctctgagaacttcaggtaggagaaaagcaaactccctccaacctcttacttcgggcttaaggcagagaactcgcctccccagaatctcctgcctacatgatcccccgctattcctctattatctttacctcggacctgcagccttgggtcgaccctgccctaggggtgactgcatgagagcatggaggatggtcaggcgtcaccaacaaccccatcacccagtaacaagaaccttgactctctcagtccctctgcatcaagacacttacccatttcccacctcatgcctgctaacttgaatgaaacaatcgctgggaaagcattaagagaattaaggctgggcactgtggctcatgcctgtaatcccagcactttgtg

SEQ ID NO: 11653 - DNA, 124 bp, Homo sapiens; identical to SEQ ID NO: 462

SEQ ID NO: 11654 - DNA, 360 bp, Homo sapiens
gcccaggaaaggtaccaaaggccaggctttcctttggtttccttcaaacataggtgaaaaaaacactgccattcacaagtcaaggaacccagggccagctggaagtgtggagcacacatgctgtgaagcacacatgctgtggagattgcaatgtgtctgaggtttgtgtagtagtggaagattttaggtatgtagagcaggttgaaaatggattgagactgcatggtggcataaatgagaaattgcctgtagcatctagtctacttgaaggaagtggagacataaggagagacaaaaacaggtttgtgccataaagtattttttcaaagacaccaagatgtggtaaatgaaaattattag

SEQ ID NO: 11655 - DNA, 650 bp, Homo sapiens
ctatatgtgcattttagttaatattgtgtattaaaggataagtcttaatgctcaaagtatgttaaaaatagatgtagtaaatcagtccctttgtgaatgtccttttgttagtttttaggaaggcctgtcctctgggagtgacctttattagtccaccccttggagctagacatcctgtacttagtcacggggatggtggaagagggagaagaggaagggtgaagggaagggctctttgctagtatctccatatctagacgatggttttagatgataaccacaggtctacaagagcgtttttagtaaagtgcctgtgttcattgtggacaaagttattattttgcaacatctaagctttacgaatggggtgacaacttatgataaaaactagagctagtgaattagcctatttgtaaatacctttgttataattgataggatacatcttggacatggaattgttaagccacctctgagcagtgtatgtcaggacttgttcattaggttggcagcagaggggcagaaggaattatacaggtagagatgtatgcagatgtgtccatatatgtccatatttacattttgatagccattgatgtatgcatctcttggctgtactataagaacacattaattcaatggaaatacac

SEQ ID NO: 11656 - DNA, 384 bp, Homo sapiens
cgttgctgtcgggcttatagtgccctccattgtaaatccatagtcatctctttaagcttattgtgtttaagaaagtagctatgtgttaaacagaggtgatggcagcccttccctagcacactggtggaagagaccccttaagaacctgaccccagtgaatgaagctgatgcacagggagcaccaaaggaccttcgttaagtgataattgtcctggcctctcagccatgaccgttatgaggaaatatcccccattcgaacttaacagatgcctcctctccaaagagaattaaaatcgtagcttgtacagatcaagagaatatactgggcagaatgaagtatgtttgtttatttttctttaaaaataaaggattttggaactctgg

SEQ ID NO: 11657 - DNA, 409 bp, Homo sapiens
  misc_feature 384: n = A,T,C or G
cgttgctgtcggaaagttcgacacagcaaactggctgagtctgtggaaaaggccattgaagagaaaaaataccttgctggggcagacccttctactgtggaaatgtgttaccctcctatcattcagagtggtggcaactataatctcaagttcagtgtggtgagtgacaagaatcatatgcactttggggctatcacttgtgccatgggtattcgcttcaagtcttactgctccaaccttgttcgcactttgatggttgatccttctcaagaagttcaagaaaattataactttttgctccagcttcaagaggagctgctgaaggaattaagacatggtgtgaagatatgtgacgtgtataacgctgtcatggacgtggttaanaagcagaagccagaactgctgaaca

SEQ ID NO: 11658 - DNA, 658 bp, Homo sapiens
  misc_feature 55: n = A,T,C or G
ccgagcaggtggatcgtgaggtcaggagatcaagaccatcctggctaacacggtngaaaccccatctctactaaaaatacaaaaaattcgccgggcgtggtggcaggcgcctgtagtcccagctactcaggaggctgaggcaggagaatggcttgaacccgggaggcggagcttgcagtgagccgagatcgcgccactgcactccagcctgggtgacagaccgagactctgtctcaaacaaaaaacaaaaaacaaaacaaaacaaagatcaaatgaatgatagaatttgaaaactacgctctttaattttacaaaatcatggattttcgtggtgatagcaatggatgcgaagaccattaggtgaaaaatggataggaagcttataatgcatggagcagaatgacaggacactaatctatattaacatctctaaatgagatcagccagatgaacttgatgtgatgaaatggatacacacagtggacacctgtgaagttttcttggctcccccaaaactgagaagtacaagttagtctccaaacctaattaccagtttacaggaaacatggggaataaaagaacaaattaacaacacaaagaagcaaacaaccaaatgcacaatttgggaaattctgcagaagtaatggcctagtttttt

SEQ ID NO: 11659 - DNA, 587 bp, Homo sapiens
gtatatacagatttgaaccttgctttttcacataatagatagttgaggtcattccatagcagtacacagaaactcatctttggtcttaaaactgcataggtactttagtcctctttgacaaatgttgggttgtttcagtcttctgctatcacaaataatgctgcaaagaatacatttgttcatatgtcatttcatccttggcaattttgcctctggaaagttcctagaagtcagattcccaggtcaaaggttaaatgcgcatgtaattttgctggatattgttaaatccccctacagagcatgcaccactcagcattcccctcagcgttgtatgagagggaccatttctccatggcctcaccagcagatttggttattgtagctctgggcttttaccaatttcacaggttaaaaatagtatctaagacaggcgtggcggctcatgcctgtaatcccagcactttgagaggccgaggaaggcagatcactggaggtcaggagttcgagatcatcctagccaacatggtgaaatcctgtctctactaaaaacataaaaattagctgggcatggtggcacatgcctgtat

SEQ ID NO: 11660 - DNA, 401 bp, Homo sapiens
ggcacgaggtggagcacgttgtggcggatgctggggctttcctgcggcatgcggctctgcaggacatcgggaagaacatttacaccatccgggaggtggtcactgagattcgggacaaggccacacgcaggcggctcgctgtcctgccctacgagctgcggttcaaggagcccttaccggaatacgtgcggctggtgactgagttttcaaagaaaacaggagactaccccagcctctctgccacggacatccaagtgcttgcactcacataccagttggaagcagagtttgttggggtgtctcacctaaaacaagaaccacagaaggttaaggtgagctcatcgattcagcacccagaaacacctctgcacatttctggtttccatctgccctacaagcct

SEQ ID NO: 11661 - DNA, 395 bp, Homo sapiens
ggcacgagagtcagctcctgctccgaagaagggttccaagaaggctgtgaccaaggcgcagaagaaggatggcaagaagcgcaagcgcagtcgtaaggagagctactccgtgtatgtgtacaaggtgctaaaacaggttcaccccgatactggcatctcatccaaggccatgggcatcatgaattccttcgttaacgacatcttcgaacgcatcgcaggcgaggcttcccgtctggcccactacaacaagcgctcgaccattacctccagggagatccagaccgccgtgcgtctgctgcttcccggagagctggccaagcacgcagtgtccgaaggtaccaaggctgtcaccaagtatacaagctccaagtaaatgtgtgcttaagtgctttaaa

SEQ ID NO: 11662 - DNA, 352 bp, Homo sapiens
gaaccctgccatgatctccctcttgcaaaagcgagggctacagaacaggcattcaggagtcctgtgctccagtcacagccttttctgttcttcagctaggagacaccaaaccctcaggaagatttactatagctaagagaaaactgcagcagaaagggcgcggctacctacttcttaaattccgtttgtggaccctcagactcttagtcccctactcccagatacagcggccctaccgtggctcctggcaagaagcatggatctcggaatccctgacctgctggacgcgtggctggagcccccagaggatatcttctcgacaggatccgtcctggagctgggactccactgg

SEQ ID NO: 11663 - DNA, 121 bp, Homo sapiens
taggcctctaattgaaccacctctctaagttatgtacgtatatataagctgaaattgtgtttgacattctgagggttttctttttctttttcctttttttttttttggggggggcctgggg

SEQ ID NO: 11664 - DNA, 256 bp, Homo sapiens; identical to SEQ ID NO: 463

SEQ ID NO: 11665 - DNA, 511 bp, Homo sapiens; identical to SEQ ID NO: 464

SEQ ID NO: 11666 - DNA, 555 bp, Homo sapiens
ctcccagcagctgcccagctatattcatccagaggcgggtttttgtttctctctcttccctcactgctgctggccccaaccatattcttgattacttatgaaggacaggctttgaaatttgacatctgtatccatcaagcccagcttgagctctgcttcagataatttaagatgtaccaggtggcacttcaggctagaaaactctgtggtctcccagcaacttaaaggaagatcgtatgtccacttaagcagtgtaaaagataactcaagaaagaaaggggcttcatcacctaactcatcaagctttagaatgtatctgcctgcacaaatacaagtagagacggggtttcaccgtgttagccaggatggtctcaaactcctgacctcgtgatccgcctgcctcgcctcccaaagtgctgggattacaggcgtgagccaccgcgccctgccacaagagggtaaggaaactgaaatatgacaaggttaaatgattcagatgaggggccggaaagcacgcctcccgagacccattcctggaagcgggtctttaaagct

SEQ ID NO: 11667 - DNA, 300 bp, Homo sapiens
  misc_feature 86, 109, 135, 208: n = A,T,C or G
tgtctcctgccgacaagaccaacgtcaaggccgcctggggtaaggtcggcgcgcacgctggcgagtatggtgcggaggccctgganaggatgttcctgtccttccccancaccaagacctacttcccgcacttcnacctgagccacggctctgcccaggttaagggccacggcaagaaggtggccgacgcgctgaccaacgccgtggngcacgtggacgacatgcccaacgcgctgtccgccctgagcgacctgcacgcgcacaagcttcgggtggacccggtcaacttcaagctcctaa

SEQ ID NO: 11668 - DNA, 343 bp, Homo sapiens; identical to SEQ ID NO: 3196

SEQ ID NO: 11669 - DNA, 345 bp, Homo sapiens
ctgtaactacagcttggaaactatgcaaatggtctagatcctcagagctcacatgataggatatagttagtgatgacattttgctcttcttgtgggaacacacacttcaaggaggagatagtgactgggagataggaacagtttaagatgcagtgtgagtctggcctgcgtgcggtgaggaggccccgccaagagactggtggacatctgactgtgggatgtgctctcaagtaggacgtcatcaggacagattctgaataggcatcatgagagtgctggtcagaaacggctgccactttttttaatttaattttattttttatttaaaggaaggaacaatagcta

SEQ ID NO: 11670 - DNA, 580 bp, Homo sapiens
caagtcaaagctttcagatctctctggcccagtgatatctttggcagttgtgaagatgaccctgtacagacactgttacatatatatttccatcatcagacgctgggccagacaggaagctttgcagttataggctctaacctggacatgtcagaagccaactacaaactgatggaacttaatctggaaataagagagtctctacgcatggtgcaatcataccaacttctagcacaggccaaaccaatgggaaatatggtgagcactggattctgagacacttcaggcctttaggaaagaaactaaactgaagatgatgaagaatattaaccaagcaccttttatggacccttgcattcactgataactttctggcagcatctactttttagtgtaactaatgtcaaactgtatcatcaaaaacaaagatctgaaagaaaaaaacatctgatattttaacagctgccaatatctcccacaataactgcgtgaagaaggaattttttaattacttaacctacgtgaaaagaaaagggctaaaagtgatgcctacaaatacattactttctggggaaagaaa

SEQ ID NO: 11671 - DNA, 432 bp, Homo sapiens
ccaatttacaaaaacaaaggaagaattagaagctgagaaaagagacttaattagaaccaatgagagactatctcaagaacttgaatacttaacagaggatgttaaacgtctgaatgaaaaacttaaagaaagcaatacaacggggggggaacttcagttaaaattggatgaacttcaagcttctgatgtttctgttaagtatcgagaaaaacgcttggagcaagaaaaggaattgctacatagtcagaatacatggctgaatacagagttgaaaaccaaaactgatgaacttctggctcttggaagagaaaaagggaatgagattctagagcttaaatgtaatcttgaaaataaaaaagaagaggtttctagactggaagaacaaatgaatggcttaaaaacatcaaatgaacatcttcaaaagcatgtgga

SEQ ID NO: 11672 - DNA, 495 bp, Homo sapiens
ccgttgctgtcgattttgctagtatggaaaaatactttatttttataatgataaaacaaggaaagtaaagatttctttttggtgtataccagagttaagggcagtagaaggcctccaactttaagaaggcaaacatggcatcaagttctcagcgaaaaagaatgagccctaagcctgagcttactgaagagcaaaagcaggagatccgggaagcttttgatcttttcgatgcggatggaactggcaccatagatgttaaagaactgaaggtggcaatgagggccctgggctttgaacccaagaaagaagaaattaagaaaatgataagtgaaattgataaggaagggacaggaaaaatgaactttggtgactttttaactgtgatgacccagaaaatgtctgagaaagatactaaagaagaaatcctgaaagctttcaagctctttgatgatgatgaaactgggaagatttcgttcaaaaatctgaaacgcgtgg

SEQ ID NO: 11673 - DNA, 310 bp, Homo sapiens
agtaactacaagtaactgggcagggatggttagctgggaagtatggatttcatttccattactaatgcctgcaattgctgataatagacatgccccaggaatcgctgcaagggaaatggagcaagggtctccttctgtggcccagtctggaatgttagtggtgcaatctcgactcactgcaacctccgcctcccggattcaagagattctcctgcctcagcctcccaagtaactgggattacacgtacgcaccaccatgcccggcaaatttttgtatttttagtagagataaggtttcaacatattggcc

SEQ ID NO: 11674 - DNA, 540 bp, Homo sapiens; identical to SEQ ID NO: 3201

SEQ ID NO: 11675 - DNA, 363 bp, Homo sapiens
  misc_feature 5, 8, 10, 13, 32, 52, 53, 57, 74, 85, 89, 97, 103, 104, 128,131, 146, 155, 158, 182, 183, 214, 222, 229, 231, 253, 257,262, 272, 285, 295, 306, 315, 327, 331, 349, 362: n = A,T,C or G
aaagnatnanccngggccactaggggcggggnccccagggccttttgggctnnctcncactggaaaaggggaangggccacccanggcnacccgcangggggnnaagggggcctccccctggttgacnggnctgttccccaccccngcgggggtngcnggggggccaggtacaggcccccannaggggggggggactggggggcccaaaaatanaggcctgncaggatncnaaacaggaatgccaaaaagggngggncccancattgggggnggaaaaaagcccncccccccaanggcgaatctcnggaaaagcnggtttcccccancccntaaaaaataaaggggggnggattccgaaaant

SEQ ID NO: 11676 - DNA, 625 bp, Homo sapiens
ttccgttgctgtcgccttgagctgggttgattgaggatgtgtgaaaagctcacagagcccgatgcctgctgctatttcacggcaatgagcctttttctttctacactgaagattttcttcttatttaatgtggtttattttgggctcagaaataattgctctgttgaaaataatcctttgtcagaaaagaaggtagctaccacatcattttgaaaggaccatgagcaactataagcaaagccataagaagtggtttgatcgatatattaggggtagctcttgattttgttaacattaagataaggtgactttttccccctgcttttaggattaaaatcaaagatacttctatatttttatcactatagatcatagttattatacaatgtagtgagtcctgcatgggtactcgatgtgtaatgaaacctgaaataataagataataagaaaagcaataattttctaaagctgtgctgtcggtgatacagagatgatactcaaattataataaaactcttcattttgtgaattatagaagctactttttataaagccatatttttttagggaaactaaggagtgacatagaactgatgaatgagcaaaagtaagttttgctggattt

SEQ ID NO: 11677 - DNA, 470 bp, Homo sapiens
gcctgtgcttaagtaagaatcaggccttattggagacattcaagcaaaggttggacaactacttttccagaacagaaaggaaactcatgcatcagaaaaggtgactaataaaggtaccagaagaatatggctgcacaaataccagaatctgatcagataaaacagtttaaggaatttctggggacctacaataaacttacagagacctgctttttggactgtgttaaagacttcacaacaagagaagtaaaacctgaagagaccacctgttcagaacattgcttacagaaatatttaaaaatgacacaaagaatatccatgagatttcaggaatatcatattcagcagaatgaagccctggcagccaaagcaggactccttggccaaccacgatagagaagtcctgatggatgaacttttgatgaaagattgccaacagctgctttattggaaatgaggactcatctgat

SEQ ID NO: 11678 - DNA, 568 bp, Homo sapiens
tccatttaaacatacggttgatgatggtctggatattagaaaggcagcatttgagtgtatgtacacacttctagacagttgtcttgatagacttgatatctttgaatttctaaatcatgttgaagatggtttgaaggaccattatgatattaagatgctgacatttttaatgttggtgagactgtctaccctttgtccaagtgcagtactgcagaggttggaccgacttgttgagccattacgtgcaacatgtacaactaaggtaaaggcaaactcagtaaagcaggagtttgaaaaacaagatgaattaaagcgatctgccatgagagcagtagcagcactgctaaccattccagaagcagagaagagtccactgatgagtgaattccagtcacagatcagttctaaccctgagctggcggctatctttgaaagtatccagaaagattcatcatctactaacttggaatcaatggacactagttagatgtttgttcaccatggggaccattacatatgaccatacaatgcactgaattgacaggttaatcataagacatggaaagag

SEQ ID NO: 11679 - DNA, 404 bp, Homo sapiens; identical to SEQ ID NO: 474

SEQ ID NO: 11680 - DNA, 397 bp, Homo sapiens
tactccagaacacagaagctcttccaaggaccttgactcaagaaggatgaggtcctcttactcttctccatttatccactatatgcttggccatttatcctaaatgtggcgggaacagacttgttatctgtcgatgttgacagtgtcttttttaacctatgtcctgcatagattggatacgtttacaaggggaggtggatggccataaaaccagtgcactttgggaattacttttctaggatttgctaccacttataaatgacattgacattcgtcatctcttttttcttttgctaaaaagaatagctgaatttaattcacctattataaaatactcaaaagtaaattgcattggtggccacttctgaattatagctacatttcattatgacccctt

SEQ ID NO: 11681 - DNA, 401 bp, Homo sapiens
aggtatgtgtgtgtgtgtgaagaaatttatttattgagacggagtctggctctgtcacccaggctggagtgcagtggtgcgatctcggctcattacaagctccgcctcccgggttcacgccattctcctgcctcagcctcctgagtagctgggactacaggcacctgccaacacgcccggctaatttttttttttttttttgtatttttagtagagacggggtttcaccgtgttagccaggatggtctaaatctcctgacctcgtgatccgcccacctaggccttccaaagtgctgggattacaggtgtgagccaccgcgcccggccaaaatttattttaaggaattaattggctcacaaagagtggcagtttgagtctaaaggcagtcagctggaaaacc

SEQ ID NO: 11682 - DNA, 154 bp, Homo sapiens
cgttgctgaccattcctagaagccactgtgcttggtagagtgcatcactcaccacaggtgcctcctgagctgcctgagcctggtgcaaaaggattggcccccattatggtgcttctgagataaatcttgccaagattgacaagcaatgatgaaa

SEQ ID NO: 11683 - DNA, 469 bp, Homo sapiens
gcgtctgggcgggtggtaggtgagtgggtattgcgggctagtatccgagcaaaagatggtggcgcaggccgagttaagagctttaatcctgtgaagacatcttagtgaagagtttagagtgctgagagttgaaagcttgcacgtgggaaacgtgcggccggactgccacatgtactgaggttgagtcgtgacggccacaggctccgagttttggcgtgaggaaccgctgatcggccacgggcgccgaacttgctggcctccggcatgtgcctgagcggcggcggaaaaaccaccttaattggggcggagggttagttttaacagcaaagggcctttactaaaatggcgaacgccttccgtcggcgttgttttaaaatgggaagcctcgaccctgtattgaaactgagctgttcgaaggcggcgttgtgtgcaattccgattaatgaaggggaagggttttgtgtggaaa

SEQ ID NO: 11684 - DNA, 609 bp, Homo sapiens; identical to SEQ ID NO: 3203

SEQ ID NO: 11685 - DNA, 709 bp, Homo sapiens
  misc_feature 28, 44, 55, 562, 582, 674, 699: n = A,T,C or G
ggcacgagagcacaatgagaggctactnaagcagtttggagccnaggccaatgtnatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccgggatcactccggcacactgggtcccgaggagttcaaagcctgcctcatcagcttgggttatgatattggcaacgacccccagggagaagcagaatttgcccgcatcatgagcattgtggaccccaaccgcctgggggtagtgacattccangccttcattgacttcatgtnccgcgagacagcccgacacagatacagcagaccaagtcatggctttcttcaagatcctggcttggggacaagactacattaccatggacgancttgcgccgcgagctgccacccgancaggcttagt

SEQ ID NO: 11686 - DNA, 524 bp, Homo sapiens
acagagggctttaaggaagcagcggagaagtttcgaatggaatctggaatcgaacctagtgtggatctggaaacacttgatgaacgaatcaagatccgggagatgatactgaaaggtcagattcaggaggccatcgccttgatcaacagcctccacccagagctcttggacacaaaccggtatctttacttccatttgcagcaacagcatttgatcgagctgatccgccagcgggagacagaggcggcgctggagtttgcacagactcagctggcggagcagggcgaggagagccgagagtgcctcacagagatggagcgtaccctggcactgctggcctttgacagtcccgaggagtcgcccttcggagacctcctccacaccatgcagaggcagaaggtgtggagtgaagttaaccaagctgtgctagattatgaaaatcgcgagtcaacacccaaactggcaaaattactgaaactactactttgggctcagaacgagctggaccagaagaaagtaaaata

SEQ ID NO: 11687 - DNA, 705 bp, Homo sapiens
  misc_feature 625: n = A,T,C or G
ggcacgagtttagagtcaagatcttttatttcctgattttaaaaatcgtcaccatcatagacctcctggcttctcttgtatctgtgttctaatggctcccagcagtgccttcacacagcccctttattccccttcttgtgcctgcccatgagcctgagtgtgacagatcaattagctttgtccctccaaactgtgggagcaggactagactcttctggcaggcagagagctcctcctcggccagtgttcgagcctggtccaccactcctcagttcttcttgctcttggcttttgtggccttggcatccagcgtgctctgggcatgagtgaggtgcttcacagcatcaagcacaaggactccaggcagcaccagccacagggcattcatgaagacaaagtaaaaccagaagtagagagggtggcccagctctccgtgctggaatccgtcgcggtgctctgtcaggaagtagagcacatccccatagatctggcccacagagaccacaagctgtagaatgaaacggaggggatgctggcggagaaaggcgatcaccacccacaggctgagtggtccccacaggcaagctgtgatggtttccatgcacactgtgaagttgtcacccangatgtatcggctgtctccttggcatactcttttcagagttgagataagaaggcttggcttccaacaggtcttcgtagtaa

SEQ ID NO: 11688 - DNA, 505 bp, Homo sapiens; identical to SEQ ID NO: 3210
  misc_feature 40, 47: n = A,T,C or G

SEQ ID NO: 11689 - DNA, 561 bp, Homo sapiens
  misc_feature 353, 399, 405, 472: n = A,T,C or G
tagattgacaagaaagagcccacctgaatgaccttgaaaatattattccatttcttggaattggcatcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtcctgtaaagaaaatcatacaactcagcatccagttggctttttaagaattctgtacttccaatttataatgaatactttcttagattttaggtaggangggagcagaggaattatgaactggggtaaacccatttgaatattancattgncaatatcctggattcttgttttacatttggattaagaaatttaacatagtaattcttaagtctttgnctggatttttaaagacctttcttataaatttgggatcatgttatgatttggtaacattcacacacacctcacttttgaatctattaaat

SEQ ID NO: 11690 - DNA, 421 bp, Homo sapiens
ctcgcagtttacgcggaagattcagagcccgagtctgatggcgaggctggaatcgaggcggtgggcagcgcggctgacgagaaaggcggattggtatctgatgcctatggggaggatgacttttctcgtctagggggtgatgaagatggttatgaagaagaagaagatgagaacagtcgacagtcggaagatgacgatgcagagactgaagaacctgaggctgatgacccaaatgataatactgaagctgaagagcgagaccccgaggaactcgtggcctccttttctgaaagagttcagaacatgtctcctgatgaaatcaagatcccgtcagaaccccctggcagatgttcaaatcacttgcaagacaagatccagaagctttatgaacgaaagataaaggagggaatggatatgaact

SEQ ID NO: 11691 - DNA, 141 bp, Homo sapiens
cgactttttaaagaagaaagcctttatttccttgtttggcaaataaaacgggctaagtgggtggcttttgggggatgggccaaagagaccaaatcccatatcctggtccgactcctccgacttttcctgggtttaaacctt

SEQ ID NO: 11692 - DNA, 550 bp, Homo sapiens
ggcttagcggataacaatttcacacaggataagactagcccccatctcaatcatataccaaatctctccctcactaaacgtaagccttctcctcactctctcaatcttatccatcatagcaggcagttgaggtggattaaaccaaacccagctacgcaaaatcttagcatactcctcaattacccacataggatgaataatagcagttctaccgtacaaccctaacataaccattcttaatttaactatttatattatcctaactactaccgcattcctactactcaacttaaactccagcaccacgaccctactactatctcgcacctgaaacaagctaacatgactaacacccttaattccatccaccctcctctccctaggaggcctgcccccgctaaccggctttttgcccaaatgggccattatcgaagaattcacaaaaaacaatagcctcatcatccccaccatcatagccaccatcaccctccttaacctctacttctacctacgcctaatctactccacctcaatcacactactccccata

SEQ ID NO: 11693 - DNA, 612 bp, Homo sapiens
  misc_feature 498: n = A,T,C or G
ctcacaatcatggcaagccaacgccacttatccagtgaaccactatcacgaaaaaaactctacctctctatactaatctccctacaaatctccttaattataacattcacagccacagaactaatcatattttatatcttcttcgaaaccacacttatccccaccttggctatcatcacccgatgaggcaaccagccagaacgcctgaacgcaggcacatacttcctattctacaccctagtaggctcccttcccctactcatcgcactaatttacactcacaacaccctaggctcactaaacattctactactcactctcactgcccaagaactatcaaactcctgagccaacaacttaatatgactagcttacacaatagcttttatagtaaagatacctctttacgggactccacttatgactccctaaagcccatgtcgaagcccccatcgctgggtcaatagtacttgccgcagtactcttgaaactagcgcntatggtataatacgcctcacactcattctcaacccctgacaaaaacacatagcctaacccttccttgttctatccctatgaagcataattataacaaagctccatctggcctac

SEQ ID NO: 11694 - DNA, 484 bp, Homo sapiens
ttgctgtcggtggcaggacagttgcattctgtggccttcttagcactggcctttgtgctggcactggcatgctgtgcctcgaatgtcactttcctgcccttcttgagccacctgccacctcgcttcttacggtcattcttcctgggtcaaggcctgagtgccctgctgccctgcgtgctggccctagtgcagggtgtgggccgcctcgagtgcccgccagcccccatcaacggcacccctggccccccgctcgacttccttgagcgttttcccgccagcaccttcttctgggcactgactgcccttctggtcgcttcagctgctgccttccagggtcttctgctgctgttgccgccaccaccatctgtacccacaggggagttaggatcaggcctccaggtgggagccccaggagcagaggaagaggtggaagagtcctcaccactgcaagagccaccaagccaggcagcaggcaccacccctg

SEQ ID NO: 11695 - DNA, 539 bp, Homo sapiens; identical to SEQ ID NO: 3215

SEQ ID NO: 11696 - DNA, 471 bp, Homo sapiens; identical to SEQ ID NO: 3216

SEQ ID NO: 11697 - DNA, 400 bp, Homo sapiens; identical to SEQ ID NO: 3219

SEQ ID NO: 11698 - DNA, 591 bp, Homo sapiens
cgttgctgtcggtacatttttgggggctacgagcagcaggcggactgtttttccaatgacattcacaagctagataccagcaccatgacatggactcttatctgtacaaagggcagccctgcacgctggagggacttccactcagccacaatgctgggaagtcacatgtatgtctttgggggccgtgccgaccgctttgggccattccattccaacaatgagatttactgcaaccgcattcgagtctttgacaccagaactgaggcttggctggactgtcccccgactccagtgctgcctgaggggcgccggagccactcggcctttggctacaatggggagctgtacatctttggtggttataatgcaaggctgaaccggcacttccatgacctctggaagtttaatcctgtgtcctttacctggaaaaagattgaaccgaaggggaaggggccatgtccccgccggcgccagtgctgctgtattgttggtgacaagattgtcctctttgggggtaccagtccatctcctgaggaaggcctgggagatgaatttgaccttatagatcattctgacttacacattttggac

SEQ ID NO: 11699 - DNA, 480 bp, Homo sapiens
tgtgaaaaatgaggtcctctttctagagtacctgacaggttgcttggcatccagaagatgtttagctaaggccttgcccgagatggacagccggattccttatgatgactacccggtggttttcttgcctgcctatgagaatcctccagcatggattcctcctcatgagagggtacaccacccggactacaacaatgagttgacccagtttctgccccgaaccatcacactgaagaagcctcctggagctcagttgggatttaacatccgaggaggaaaggcctcccagctaggcatcttcatctccaaggtgattcctgactctgatgcacatagagcaggactgcaggaaggggaccaagttctagctgtgaatgatgtggatttccaagatattgagcacagcaaggctgttgagatcctgaagacagctcgtgaaatcagcatgcgtgtgcgcttcttttccctacaattatcatc

SEQ ID NO: 11700 - DNA, 461 bp, Homo sapiens
ggcacgagagtctcgagtttttttttttttttttgctgaatccaaagatatataaataaaatatatatattttataaagatcagaatgatataaaggagatacatgtttcttcctttaaaaaataaacggaagttacattgttaatgttcatattatgatgccacttttctaaactgcatctggattgaaaggtgtaaatatcaataacagtgctacttagttatcagtatttaatatctgaggtgagttgggggtatctatattaggggtagggtattacagaagataattggcttgatgtcctagaagttctttgatccagaggtgggtgcagctgaaagtaaacagaatggattgccagttacatgtatgcctgcccagttccctttttatttgcagaagctgtgagttttgttcacaattaggttcctaggagcaaaacctcaaggattgatttatt

SEQ ID NO: 11701 - DNA, 345 bp, Homo sapiens; identical to SEQ ID NO: 489
  misc_feature 309, 315, 340: n = A,T,C or G

SEQ ID NO: 11702 - DNA, 393 bp, Homo sapiens
ggcacgaggggggtgctgcgcagctggcggggccggcggcggaggctgaccccctaggacgcttcacgtgtcccgtgtgcttagaggtgtacgagaagccggtacaggtgccctgcggacacgtcttttgctctgcatgcctgcaggaatgtctgaagccgaagaagcctgtctgtggggtgtgtcgcagcgctctggcacctggcgtccgagccgtggagctcgagcggcagatcgagagcacagagacttcttgccatggctgccgtaagaatttcttcctgtccaagatccggtcccacgtggctacttgttccaaataccagaattacatcatggaaggtgtgaaggccaccattaaggatgcatctcttcagccaaggaatgttccaa

SEQ ID NO: 11703 - DNA, 300 bp, Homo sapiens
gatgcatgcttattgaaaattagaacacagataaattatgaaagtagtaaaaccacagaaacaatttttctatatatatagaaacatgttttaatatactgtcttaactttcttacttgataatctggagtcatctttcagggtaatacttgtatcccattaattttagtggctacacagctttttatagagatgtagtgtactttaatctcctaatgatggatctatagattgcttctattattttctcttacaatgtcgctttatacaaaactgtctatttatgtggacttgttagaa

SEQ ID NO: 11704 - DNA, 1059 bp, Homo sapiens
  misc_feature 2, 4, 5, 6, 7, 8, 18, 19, 20, 21, 22, 23, 24, 25, 26, 27,28, 29, 30, 31, 32, 33, 34, 35, 36, 37, 38, 39, 40, 41,42, 43, 44, 45, 46, 47, 48, 49, 50, 51, 52, 53, 54, 55,56, 57, 58, 59, 60, 61, 62, 63, 64, 65, 66, 67, 68, 69,70, 71: n = A,T,C or G
  misc_feature 72, 73, 74, 75, 76, 77, 78, 79, 80, 81, 82, 83, 84, 85, 86,87, 88, 89, 90, 91, 92, 93, 94, 774, 799, 847, 880, 886,893, 913, 923, 944, 949, 950, 964, 965, 973, 981, 987, 993,1003, 1004, 1011, 1012, 1021, 1028, 1042, 1043, 1045: n = A,T,C or G
  misc_feature 1046, 1047, 1048, 1054, 1055, 1056, 1057, 1059: n = A,T,C or G
gngnnnnnttaactcccnnnnnnnnnnnnnnnnnnnnnnnnnnnnnnnnnnnnnnnnnnnnnnnnnnnnnnnnnnnnnnnnnnnnnnnnnnnnntactttttttttcttttctttctttttttttttttttttaatttttgagatggagttttgctcttgttgcccacgctggagtgcaatggcgcaatcttggctcattgcaacctccacctcccggattcaagcgatccttctgccttagcttcccaagtagctgggattatagacgtgtgccaccattcccagctgatttttgtatttttagtagagatggggtttcaccacgttggccaggctagtctcgaactcccgacctcatgtgatcctcccaccgcagcctcccaaagtgctgggattacaggcgtgagccaccatacccggttgattgtagacttttgattggtatttacaaggacccatgagaggcaacaaagagaagttgtcaagagaacagaccctgagaccaatagtttggctcaagctctggctccctaacttcctaccagtttgaccttgggcaagttacctaacatctttgtgcctccattttctatttgtaaaaggaaactaatagtagtgcctactttataatagagttattacaaatattaaatgagttaatatttgtaaagtaattagaaaaatgcctggcacttcaaaagcagccttcatttattctttggaaataattttaaatgaattcaagggttatatgtagcttttaggcatatatncctaaatggcactgtaaaactgcanaaatatccgatctttaaaaatttttgggtaaatttatcataatatggnaaccaaatcccatttaatggcttttaggggtanccgatnaaaaccngaagtttgcagtttaagccncttatggaangggacccgaaattccaaggancccanngggaaaaaaccccnngaggaatnttggccgntttaanttaaancctttgggtnntttaagnncctaaaaantttttgnccctggattttggnntnnnnaaaaannnntn

SEQ ID NO: 11705 - DNA, 539 bp, Homo sapiens
ttatttatttcaatacttttcagtctctccccatcttttgtgataacacaaatactagatcttttgttatagtccctcaattccccaaggctgtattggcctcctagcatgttaatagatataactcacataaaaaattattgaggtcttcaataattttttttttgagacagggactctctctgttgcccaggctggagtgcagtggcacaatcacggctcactggaggcctaaattgcctgggctcaagtgattccctcatcttagcctcccaagtagctgggaccacagacgtgtgccaccaggctgggttattatttttagatacgaggtctcgttatgttggccagactggtctcaaattcctgggctcaagcaatcctctcgccatgtcctcccaaagttctgggattacaggcgtgagctaccacacctggccagccctcaataatttttaagagtgaaaaaagtctcctgaagccaaaaagtttgaggacctgtgaggtacaaaaaaactaatattaaagaaagttcttac

SEQ ID NO: 11706 - DNA, 542 bp, Homo sapiens; identical to SEQ ID NO: 3222

SEQ ID NO: 11707 - DNA, 486 bp, Homo sapiens
tgcagctccagcagcaatggcagtgacggcgttggcggcgcggacgtggcttggcgtgtggggcgtgaggaccatgcaagcccgaggcttcggctcggatcagtccgagaatgtcgaccggggcgcgggctccatccgggaagccggtggggccttcggaaagagagagcaggctgaagaggaacgatatttccggtgaggctcaccgggtcccaagtccagccctggatctcccaatggccttccaatccttaaactgccaatcgccccacccgttcctacctggtgccttgggcgccccatcccccaacagaactcccgggccccaatccagtataccctaacccttgatgtcccgaccgttgccacgtatagggcactcccagttacctgcacaacagtttcaggcccccaaaccgtttccaccggcgggtctccaaaacaacccacggctcaactcctcctttatcattaccatctcccgcg

SEQ ID NO: 11708 - DNA, 300 bp, Homo sapiens
gagaaagcttaccatcgagggtgtggttgatccttgaagctgcttggtaaagttatcatttcctcagtcttttcttttgtactcctatcatgtattcattaatatctaccagtcccttttcattctaagacaaaacatttctcctaaatctctgaataaaatcagtgctgtaggaagatggactgtgttgatcatgggtgtaagcaacccagtttaagaaacatggcaactaaagggatacctcaggctttctttcccagtgggtcatttttgtcctagttcagtgtgtctgttactatt

SEQ ID NO: 11709 - DNA, 690 bp, Homo sapiens
  misc_feature 588, 644, 663, 668: n = A,T,C or G
ggcacgagcccaaggttgtggtatgctgctttactgtctttcacaagcgccttttatatcctgtcaatcatctgtgtcgggctgctctatacatattacaccaaaccagatggctgcacagaaaacaagttcttcatcagtattaacctgatcctttgcgttgtggcttctattatatcgatccacccaaaaattcaggaacaccagcctcgctccggcctcttgcagtcctccctcatcaccctctacactatgtacctcacctggtcagccatgtccaatgaacctgatcgttcctgcaatcccaacctgatgagctttattacacgcataactgcaccaaccctggctcctggaaattcaactgctgtggtccctacccctactccaccatcaaagagtgggtctttactggattcagataattttattggactgtttgtctttgttctctgcctcttgtattctagcatccgcacttccactaatagccaagtagacaagctgaccctgtcagggagtgacagcgtcatccttggtgatacaactaccagtggtgccagtgatgaaagaagatggacagccttnggcgggctgtggacaacgagaaagaaggaatgcagtatagctactccttattccanctatgctctgcttggcttncttgnacattatgatgaccctgaccag

SEQ ID NO: 11710 - DNA, 502 bp, Homo sapiens
ggcagcatggcgtccgtggcgctgagcgaggcggagaaggtgtacatcgtgcatggcgtccaggaagacctccgtgtggatggccgtggctgtgaggactaccgatgtgtcgaagtggaaactgatgtggtgtccaacactagtgggtccgccagggtcaagctgggtcacacagacatcttggtgggagtgaaagcagaaatggggacgccgaagctggagaaaccaaatgaaggctacttggagttctttgttgactgttcagccagtgctacccctgaatttgaaggtagaggaggtgatgaccttggcaccgagatcgctaacaccctctatcggatatttaacaataaaagcagtgtcgacttaaagaccctctgcattagtcctcgggagcactgctgggttctctatgtggatgtgctgcttctggaatgtggtggaaatttgtttgatgccatttccattgctgtaaaggctgctctcttcatacaaggatacc

SEQ ID NO: 11711 - DNA, 677 bp, Homo sapiens
  misc_feature 613, 639, 667, 673: n = A,T,C or G
ggcacgagggcagccaaggaactgtgacccgatggtggactttttggatagttgggtgcacattattcctgtgtggatcttagataacatactggaccaactcatcttccccaagctgcaaaaggaggtggaaaactggaacccgctcacagacactgttcccatccactcttggatccacccatggctgccccttatgcaggcacggctggagccactctattcccccatccgtagtaagctgtccagcgccctgcagaagtggcaccccagcgactcctctgccaagctcatcctccagccctggaaggatgtcttcactcctggctcctgggaagcattcatggtcaaaaacatagtgcccaagctggggatgtgtcttggtgagctagtcattaacccccaccagcagcacatggatgcattctattgggtgattgactgggaagggatgatctctgtctctagcctggtgggacttcttgaaaagcacttcttccccaagtggcttcaggtgctgtgctcttggctcagtaacagcccaaattatgaggagatcaccaagtggtacctgggttggaagtccatgtctcagaccaagtgctggcacatncatctgtcaaggacaaatttaatgangcactttgatatcatgaaccgggccggngtcctncaat

SEQ ID NO: 11712 - DNA, 111 bp, Homo sapiens
ctctgtcctacttctgactttacttgcggggtgaccatgttcattataatctcaaaggagaaaaaaaaccttgcaaaaaaagctaaaatgacaacacaaaaacaatcttat

SEQ ID NO: 11713 - DNA, 383 bp, Homo sapiens
ccggctgctgcgccccctcctgccagggtggcgattccgctccacagtctcggacggatctgctcagaaaggaagaggcaggcgccagggggaacccccttcgtgttttgtgaccctcccttttaggtgaagcccctttttcttgctaaaaccggcaattctccggttagaaatgttacttggtgttttttggttttgtgaaacggccgtcccaaagctggctggattcctagaagagtctgtgttgaaggcatctttcaagccctcgctctggttctcagggcagcattttccaggcgggtttgttttgcatttcttggagcctctccgagcagcaaccagacgggagatttttattttaagctgttcatgctgggactgac

SEQ ID NO: 11714 - DNA, 300 bp, Homo sapiens
gaagatatatgactcctttgggctacatttcatattgatcaatttctaggtatttttcactggcccaaagtattgcattcccttaacagcaagcacaagttctctatatcacttgttttttgttgttgttgttgttgtcgtcgttgttttgagacggagtcttgctcaggtgccccggagtgcagtggtgcaatctcagctcactgcaacctccacctcctgggttcaagcaattctcctgcttcagcctcccgagtagctgggattacaggtgtgtaccaccacgcctggcaatttttt

SEQ ID NO: 11715 - DNA, 266 bp, Homo sapiens
ttccgttgctgtcggtgaccaccgcgcctggctgagataggttgttttttgaattaactattcttttttttttttttttttttaaaaaaaaaaatttccttttttttcccccgggtggaagcccaggggccaaaaatttagggttattgaaacctttgcccccaaggttaaagggattcccccccccaaatttcccaaaagggggggattaacgggtttgccccatacccccggttttttttttttttttggaaaaaacggggttt

SEQ ID NO: 11716 - DNA, 53 bp, Homo sapiens; identical to SEQ ID NO: 3227

SEQ ID NO: 11717 - DNA, 493 bp, Homo sapiens
gttgctgtcggtcacctccgcctctgctccccgacccggccatgcgcggcctggggctctggctgctgggcgcgatgatgctgcctgcgattgcccccagccggccctgggccctcatggagcagtatgaggtcgtgttgccgcggcgtctgccaggcccccgagtccgccgagctctgccctcccacttgggcctgcacccggagagggtgagctacgtccttggggccacagggcacaacttcaccctccacctgcggaagaacagggacctgctgggttccggctacacagagacctatacggctgccaatggctccgaggtgacggagcagcctcgcgggcaggaccactgcttctaccagggccacgtagaggggtacccggactcagccgccagcctcagcacctgtgccggcctcaggggtttcttccatgtggggtcagacctgcacctgatcgagcccctggatgaaagtggcgagggcggacg

SEQ ID NO: 11718 - DNA, 585 bp, Homo sapiens
agccaggcacgatggccaccttcccaccagcaaccagcgccccccagcagcccccaggcccggaggacgaggactccagcctggatgaatctgacctctatagcctggcccattcctacctcggaggtggaggccggaaaggtcgcaccaagagagaagctgctgccaacaccaaccgccccagccctggcgggcacgagaggaaactggtgaccaagctgcagaattcagagaggaagaagcgaggggcacggcgctgagacagagctggagatgaggccagaccatggacactacacccagcaatagagacgggactgcggaggaaggaggacccaggacaggatccaggccggcttgccacaccccccacccctaggacttattcccgctgactgagtctctgaggggctaccaggaaagcgcctccaaccctagcaaaagtgcaagatggggagtgagaggctgggaatggaggggcagagccaggaagatcccccagaaaagaaagctacagaagaaactggggctcctccagggtggcagcaacaataaatagacacgcacggcagccacagcttgggt

SEQ ID NO: 11719 - DNA, 297 bp, Homo sapiens
ggcacgaggtgacatgctctgagcttgccttctttgacccgtcactcctccacctcctttatttccctgatgaccagaagtttgccatctacatgccactcttcctgcctatggctgtgcccatcctcctgtccctggtcaagatcttcctggagacccgcaagtcctggataaagcctgagaacacagactgagcagggcagcacctccataggaagccttcctttctggccaacgtgggcggtgttatattgtgaggcacgtacatggggcctgccggaatgacttaaatatttg

SEQ ID NO: 11720 - DNA, 400 bp, Homo sapiens; identical to SEQ ID NO: 493

SEQ ID NO: 11721 - DNA, 399 bp, Homo sapiens; identical to SEQ ID NO: 494

SEQ ID NO: 11722 - DNA, 320 bp, Homo sapiens; identical to SEQ ID NO: 3230

SEQ ID NO: 11723 - DNA, 546 bp, Homo sapiens
attccgttgctgtcgattgccttaaaggaaggttttcattttgaggaaacattaactggctttaagtggatgggaaacagagccaaacagctaatagaccaggggaaaactgttttatttgcatttgaagaagctattggatacatgtgctgcccttttgttctggacaaagatggagtcagtgccgctgtcataagtgcagagttggctagcttcctagcaaccaagaatttgtctttgtctcagcaactaaaggccatttatgtggagtatggctaccatattactaaagcttcctattttatctgccatgatcaagaaaccattaagaaattatttgaaaacctcagaaactacgatggaaaaaataattatccaaaagcttgtggcaaatttgaaatttctgccattagggaccttacaactggctatgatgatagccaacctgataaaaaagctgttcttcccactagtaaaagcagccaaatgatcaccttcacctttgctaatggaggcgtggccaccatgcgcaccagtgggacagag

SEQ ID NO: 11724 - DNA, 539 bp, Homo sapiens
attccgttgctgtcgactcagcgtcgctggcagccgctgtacttggaaattcgaaatgagtcccatgactatcctcatagagtggccaagtttccagaaaacagaaatcgaaacagatacagagatgtaagcccatatgatcacagtcgtgttaaactgcaaaatgctgagaatgattatattaatgccagtttagttgacatagaagaggcacaaaggagttacatcttaacacagggtccacttcctaacacatgctgccatttctggcttatggtttggcagcagaagaccaaagcagttgtcatgctgaaccgcattgtggagaaagaatcggttaaatgtgcacagtactggccaacagatgaccaagagatgctgtttaaagaaacaggattcagtgtgaagctcttgtcagaagatgtgaagtcgtattatacagtacatctactacaattagaaaatatcaatagtggtgaaaccagaacaatatctcactttcattatactacctggccagattttggagtccctgaatc

SEQ ID NO: 11725 - DNA, 608 bp, Homo sapiens
ttggcagcatctttacttggcctgggtttgcacccaatttctggacattttatagctgagcattacatgttcttaaagggtcatgaaacttactcatattatgggcctctgaatttacttaccttcaatgtgggttatcataatgaacatcatgatttccccaacattcctggaaaaagtcttccactggtgaggaaaatagcagctgaatactatgacaacctccctcactacaattcctggataaaagtactgtatgattttgtgatggatgatacaataagtccctactcaagaatgaagaggcaccaaaaaggagagatggtgctggagtaaatatcattagtgccaaagggattcttctccaaaactttagatgataaaatggaatttttgcattattaaacttgagaccagtgatgctcagaagctcccctggcacaatttcagagtaagagctcggtgataccaagaagtgaatctggcttttaaacagtcagcctgactctgtactgctcagtttcactcacaggaaacttgtgacttgtgtattatcgtcattgaggatgtttcactcatgtctgtcattttataagcatatcatttaa

SEQ ID NO: 11726 - DNA, 550 bp, Homo sapiens; identical to SEQ ID NO: 495

SEQ ID NO: 11727 - DNA, 457 bp, Homo sapiens
gttgctgtcgctcatgcctgggcaggaccctgagaaaacataggagacatgttccagaaccaggaccgcaaccaggacggcaagatcacagtcgacgagctcaagctgaagtcagatgaggacgaggagcgggtccacgaggagctctgaggggcagggagcctggccaggcctgagacacagaggcccactgcgagggggacagtggcggtgggactgacctgctgacagtcaccctccctctgctgggatgaggtccaggagccaactaaaacaatggcagaggagacatctctggtgttcccaccaccctagatgaaaatccacagcacagacctctaccgtgtttctcttccatccctaaaccacttccttaaaatgtttggatttgcaaagccaatttggggcctgtggagcctggggttggatagggccatggctggtcccccaccatacc

SEQ ID NO: 11728 - DNA, 371 bp, Homo sapiens
tactcacagtgatgaagtaacagacagcatcaactgggcaagtggtgaggatgaccatgtagttgccacagctgaatatgattttgctgccgtatctgaagaagaaatttctttccgggctggtgatatgctgaacttagctctcaaagaacatcaacccaaagtgcgtggttggcttctggctagactcgatggccaaacaacaggacttatacctgcgaattatgtcaaaattcttggcaaaagagaaggtaggaaaacggtggattcaagtaaagtttccaagcatcaacaatcttttaccaacccaacactaactaaaggagccacggctgctgattctttggatgaacaggaagctgcctttgaat

SEQ ID NO: 11729 - DNA, 414 bp, Homo sapiens; identical to SEQ ID NO: 224
  misc_feature 261: n = A,T,C or G

SEQ ID NO: 11730 - DNA, 133 bp, Homo sapiens; identical to SEQ ID NO: 496

SEQ ID NO: 11731 - DNA, 65 bp, Homo sapiens
ttaataaatataagtccaagagctgtcagcctaatctgtaagagcagaacctgtgattgaccaaa

SEQ ID NO: 11732 - DNA, 502 bp, Homo sapiens
gttggttcagctggcgatagcggcgggagcggagccggcggggcctgtgcgaccgcctgggtttgtgaaatggctgctgacatttctgaatccagcggggctgactgcaaaggagacccaaggaacagtgccaagttagatgccgattacccacttcgagtcctttattgtggagtctgttcattaccaacagagtactgtgaatatatgcctgatgttgctaaatgtagacaatggttagagaagaattttccaaatgaatttgcaaaacttactgtagaaaattcacccaaacaagaagctggaattagtgagggtcaaggaacagcaggggaagaagaggagaagaaaaaacagaagagaggtggaaggggtcaaataaaacaaaaaaagaagaccgtaccacaaaaggttactatagccaaaattcccagagcaaagaagaaatatgtgacaagagtatgtggccttgcaacttttgaaattgatcttaaagaagcac

SEQ ID NO: 11733 - DNA, 300 bp, Homo sapiens
ggaagacagcagagcagaggaatctatatagatgtatgcacagacctgtctgtatgctgaactttgttaaaaatatctgccagttattaaaaagcacagtttaaatggggtggggttaaagttcaggtaagtaagttagagagaaaacattgtatgatcagctcctgcacttgatctatctatctttggcttcccaaacagtaactcactccaggccaagtgtgccttagcacgagtgaccacagtttaatagaccacacacatcgtttaacctgctcttggtcattggaaatttacact

SEQ ID NO: 11734 - DNA, 509 bp, Homo sapiens; identical to SEQ ID NO: 3234
  misc_feature 311: n = A,T,C or G

SEQ ID NO: 11735 - DNA, 323 bp, Homo sapiens
ggcacgaacgcatcgaggcaccatgggcgcgtgtggacgaaatgaggggctacgcggagaagctcatcgactatgggaagctgggagacactaacgaacgagccatgcgcatggctgacttctggctcacagagaaggatttgatcccaaagctgtttcaagtactggcccctcggtacaaagatcaaactgggggctacacaagaatgctgcagatcccaaatcggagtttggatcgggccaagatggcagtgatcgagtataaagggaattgcctcccacccctgcctctgcctcgcagagacagccaccttacactccta

SEQ ID NO: 11736 - DNA, 543 bp, Homo sapiens
gcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatgttaaaggataaaggaaagccagagagtgagggagaggcaaaagaaggaaagtcagagagggagggagagtcagagatggagggaggatcagagagagagggaaaaccagagatagagggaaagccagagagtgaaggagagccagggagtgaaacaagggctgcaggaaagcgcccagctgaggatgatgtacccaggaaagccaaaagaaaaactaataaggggctggctcattacctcaaggagtataaagaggccatacacgatatgaatttcagcaatgaggacatgataagagaatttgacaatatggctaaggtgcaggatgagaagagaaaaagcaaacagaaattgggggcgtttttgtggatgcaaagaaatttacaggaccccttctaccct

SEQ ID NO: 11737 - DNA, 470 bp, Homo sapiens
ggcagatgtgctcaaggtggaagtcttcagacagacagtggccgaccaggtgcttgtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcccagcctagcaccattgccaccagcatgcgggattccctcattgacagcctcacctgagtcaccttccaagttgttccatgggctcctggctctggactgtggccaaccttctccacattccgcccaatctgtaccggatgctggcagggaggtggcagagagctcactgggactg

SEQ ID NO: 11738 - DNA, 362 bp, Homo sapiens
tggaggccaagatgttggcccagaaggctgaggaaaaggagaaccattgtcccacaatgctccggcccctttcacatcgcacagtcacaggggcaaagcccctgaaaaaggctgtggtgatgcccctacagctaattcaggagcaggcagcatccccaaatgccgagatccacatcctgaagaataaaggccggaagagaaagctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccg

SEQ ID NO: 11739 - DNA, 496 bp, Homo sapiens
attcggcacgagggccgttccacagcgggcgtggaccgtggagcagctgcgcagtgagcagctgcccaagaaggacattatcaagtttctgcaggaacacggttcagattcgtttcttgcagaacataaattattaggaaacattaaaaatgtggccaagacagctaacaaggaccacttggttacagcctataaccatctttttgaaactaagcgttttaagggtactgaaagtataagtaaagtgtctgagcaagtaaaaaatgtgaagcttaatgaagataaacccaaagaaaccaagtctgaagagaccctggatgagggtccaccaaaatatactaaatctgttctgaaaaagggagataaaaccaactttcccaaaaagggagatgttgttcactgctggtatacaggaacactacaagatgggactgtttttgatactaatattcaaacaagtgcaaagaagaagaaaaatgccaagcctttaagtttt

SEQ ID NO: 11740 - DNA, 468 bp, Homo sapiens
cgttggcaagtttgaactcacaggctacctcctgcaccccgaggtgttcctcagattgaagtcacttttgacattgatgccaatggtatactcaatgtctctgctgtggacaagagtacgggaaaagagaacaagattactatcactaatgacaagggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcagactgctgagaaggaagaatttgaacatcaacagaaagagctggagaaagtttgcaaccccatcatcaccaagctgtac

SEQ ID NO: 11741 - DNA, 472 bp, Homo sapiens
gtggttgcagtggctgaaaaaatctttagaaggagcagatcttcctaatctcttgttttacggaccacctggaactggaaaaacatccactattttggcagcagctagagaactctttgggcctgaacttttccgattaagagttcttgagttaaatgcatctgatgaacgtggaatacaagtagttcgagagaaagtgaaaaattttgctcaattaactgtgtcaggaagtcgctcagatgggaagccgtgtccgccttttaagattgtgattctggatgaagcagattctatgacctcagctgctcaggcagctttaagacgtaccatggagaaggagtcgaaaaccacccgattctgtcttatctgtaactatgtcagtcgaataattgaacccctgacctctagatgttcaaaattccgcttcaagcctctgtcagataaaattcaacagcagcgattactagacatt

SEQ ID NO: 11742 - DNA, 576 bp, Homo sapiens
tgtgatggcctcgatcggattgttgagcgctgtgacctgcctgaaatgcatgtgggtgattggatgctctttgaaaacatgggcgcttacactgttgctgctgcctctacgttcaatggcttccagaggccgacgatctactatgtgatgtcagggcctgcgtggcaactcatgcagcaattccagaaccccgacttcccacccgaagtagaggaacaggatgccagcaccctgcctgtgtcttgtgcctgggagagtgggatgaaacgccacagagcagcctgtgcttcggctagtattaatgtgtagatagcactctggtagctgttaactgcaagtttagcttgaattaagggatttggggggaccatgtaacttaattactgctagttttgaaatgtctttgtaagagtagggtcgccatgatgcagccatatggaagactaggatatgggtcacacttatctgtgttcctatggaaactatttgaatatttgttttatatggatttttattcactcttcagacacgctactcaagagtgcccctcagctgctgaacaagcatttgtagctt

SEQ ID NO: 11743 - DNA, 384 bp, Homo sapiens
ggcttagcggataacaatttcacacaggagctagcagaccagagaagggctacatatggactcatgttgggcctactcctgcaataacaattaaggaatcagttgccaaccatttgtagttcacaaattaaaactgggtttccaggcctggtgtggtggctcacgcctgtagccccagctattgcaccactgctctccaagctgggcaatggagtcagattctctttcttaaaaaaccacaaaaaaactggatttccagttctctaatattcttagtaccacaagatatgtcataggtatctttaaatgaaattcttagctggaaaagtgactaaaaattttttctcctgctacctagtaataaacaaatcattgtttattact

SEQ ID NO: 11744 - DNA, 142 bp, Homo sapiens
cacgtctttacgtgggtacttgcgcttactttgtagccttcatcagggtttgctgaaaatggcggtatataggctgagcaaaaggtggtgaggttgatcggggtttatcgattacagaacaggctcctctaaagggatatga

SEQ ID NO: 11745 - DNA, 130 bp, Homo sapiens; identical to SEQ ID NO: 3237

SEQ ID NO: 11746 - DNA, 385 bp, Homo sapiens; identical to SEQ ID NO: 3238

SEQ ID NO: 11747 - DNA, 565 bp, Homo sapiens
cgttgctgtcgctcttgtcggaccagggctaccgggtggacgggcggcgcgccggggagctgcgcaagatccaggcgcggatgggcgtgttcgcgcaggctgacggctcggcctacattgagcagggcaacaccaaggcactggctgtggtctacggcccgcacgagatccggggctcccgggctcgagccctgccggacagggccctagtgaactgtcaatatagttcagcgaccttcagcacaggtgagcgcaagcgacggccacatggggaccgtaagtcctgtgagatgggcctgcagctccgccagactttcgaagcagccatcctcacacagctgcacccacgctcccagattgatatctatgtgcaggtgctacaggcagatggtgggacctatgcagcttgtgtgaatgcagccacgctggcagtgctggatgccgggatacccatgagagactttgtgtgtgcgtgctcagctggcttcgtggacggcacagccctggcggacctcagccatgtggaggaagcagctggtggcccccagctggccctggccctgct

SEQ ID NO: 11748 - DNA, 565 bp, Homo sapiens
ccgttgctgtcgggatcatgtctgcgagccaggattcccgatccagagacaatggccccgatgggatggagcccgaaggcgtcatcgagagtaactggaatgagattgttgacagctttgatgacatgaacctctcggagtcccttctccgtggcatctacgcctatggttttgagaagccctctgccatccagcagcgagccattctaccttgtatcaagggttatgatgtgattgctcaagcccaatctgggactgggaaaacggccacatttgccatatcgattctgcagcagattgaattagatctaaaagccacccaggccttggtcctagcacccactcgagaattggctcagcagatacagaaggtggtcatggcactatgagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtcccccaaatacatcaagatgtttgtactggatga

SEQ ID NO: 11749 - DNA, 574 bp, Homo sapiens
cgttgctgtcggcaggtttcttgccttgatgtactggagcatcagatcacacggcggcttggagaaacccagggaccatgggcgcctccaggctctataccctggtgctggtcctgcagcctcagcgagttctcctgggcatgaaaaagcgaggcttcggggccggccggtggaatggctttgggggcaaagtgcaagaaggagagaccatcgaggatggggctaggagggagctgcaggaggagagcggtctgacagtggacgccctgcacaaggtgggccagatcgtgtttgagttcgtgggcgagcctgagctcatggacgtgcatgtcttctgcacagacagcatccaggggacccccgtggagagcgacgaaatgcgcccatgctggttccagctggatcagatccccttcaaggacatgtggcccgatgacagctactggtttccactcctgcttcagaagaagaaattccacgggtacttcaagttccagggtcaggacaccatcctggactacacactccgcgaggtggacacggtctagcgggagcccagggcagcccctgggca

SEQ ID NO: 11750 - DNA, 499 bp, Homo sapiens
cgttgctgtcgacgggtcgccgctgcgccgggccgggatggcggccaccgcgctgctggaggccggcctggcgcgggtgctcttctacccgacgctgctctacaccctgttccgcgggaaggtgccgggtcgggcgcaccgggactggtaccaccgcatcgaccccaccgtgctgctgggcgcgctgccgttgcggagcttgacgcgccagctggtacaggacgagaacgtgcgcggggtgatcaccatgaacgaggagtacgagacgaggttcctgtgcaactcttcacaggagtggaagagactaggagtcgagcagctgcggctcagcacagtagacatgactgggatccccaccttggacaacctccagaagggagtccaatttgctctcaagtaccagtcgctgggccagtgtgtttacgtgcattgtaaggctgggcgctccaggagtgccactatggtggcagcatacctgattcaggtgcacaaatggagt

SEQ ID NO: 11751 - DNA, 518 bp, Homo sapiens
ggcacgagatcaatttgtaattttagtattaactctgtaaaagtgtctgtaggtacgttttatattatataaggacagaccaaaaatcaacctatcaaagcttcaaaaactttgggaaagggtgggattaagtacaagcacatttggcttacagtaaatgaactgattattattaactgcttttgcccatataaaatgctgatatttactggaaacctagccagcttcacgattatgactaaagtaccagattataatgccagaatataatgtgcaggcaatcgtggatgtctctgacaaagtgtgtctcaaaaataatatactattacattaaagaaatttaatgtttctctggagttggggctctaggctttcagagtttggttaatcagtgttgattctagatgatcaacataatggaccactcctgaatgagacttaattttgtctttcaaatttactgtcttaaatcagtttattaaatctgaattttaaaacatgctgtttatgacacaatg

SEQ ID NO: 11752 - DNA, 446 bp, Homo sapiens
aacaaaggagggagcttccatccttcttgatggacgaaaaattaaagtgaaaggctatgaaaatggcaactttgttggaccaaccatcatctcgaatgtcaagccaaatatgacctgttacaaagaggagatttttggtccagttcttgtggttctggagacagaaacattggatgaagccatccagattgtaaataacaacccatatggaaatggaactgccatcttcaccaccaatggagccactgctcggaaatatgcccacttggtggatgttggacaggtgggagtgaatgtccccattccagtgcctttgccaatgttctcattcaccggctctcgatcctccttcaggggagacaccaatttctatggcaaacagggcatccaattctacactcagttaaagaccattacttctcagtggaaagaagaagatgctactc

SEQ ID NO: 11753 - DNA, 557 bp, Homo sapiens
ttcaccgtattcaacatctgtcatctcttagtgtctgcagtctgaacctaaccttgaccttttttccctctggtttgagaaaactttggacactatttctacttggccaggtgtgggctcaagagccttactctttccatctcagtttaggggcgcagccagctcctcttcccaatagggctctttctgctttccctctccttggccctagatttgtaatccatgaaaaagcacaaggtcctggctccttgcggtcacattctggttctctgtgttttgtggactctgctctcactgttcacccagcactagcagtaccagatggttctgtggagtcctggggaatggagagagcacagtctgactccctgccaagtagccaggagttgacttgcccatggtccgctggctttcccaccacttcctacaggatgggatctaagagactcaagagctgggtttctttcagcactctgtactgtcccaaatagcaaacaaatcactttgtagccagatttctgaatggaaatgagaaattgaattctccatggactttt

SEQ ID NO: 11754 - DNA, 144 bp, Homo sapiens
cgattcgtgctgaatgagcttatggacagtgcaaaagtgtctaacagcccttcccaggccattgaagtagtagagctggcaagtgccttcagcttacctatttgtgagggcctcacccagagagtaatgagtgattttgcaatc

SEQ ID NO: 11755 - DNA, 300 bp, Homo sapiens
cggcacgagggcggaacaggctaccaagtccgtgctgtttgtgtgtctgggtaacatttgtcgatcacccattgcagaagcagttttcaggaaacttgtaaccgatcaaaacatctcagagaattggagggtagacagcgcggcaacttccggtgggtcattgacagcggtgctgtttctgactggaacgtgggccggtccccagacccaagagctgtgagctgcctaagaaatcatggcattcacacagcccataaagcaagacagattaccaaagaagattttgccacatttgattat

SEQ ID NO: 11756 - DNA, 558 bp, Homo sapiens
atgctgtcaatgtatttgatatccagcaagggtttgataatccccaggtgcggttctttctgggtgacctctgcagccgacaggatctgtacccagctctgaaaggtgtaaacacagttttccactgtgcgtcacccccaccatccagtaacaacaaggagctcttttatagagtgaattacattggcaccaagaatgtcattgaaacttgcaaagaggctggggttcagaaactcattttaaccagcagtgccagtgtcatctttgagggcgtcgatatcaagaatggaactgaagaccttccctatgccatgaaacccattgactactacacagagactaagatcttacaggagagggcagttctgggcgccaacgatcctgagaagaatttcttaaccacagccatccgccctcatggcattttcggcccaagggacccgcagttggtacccatcctcatcgaggcagccaggaacggcaagatgaagttcgtgattggaaatgggaagaacttggtggacttcacctttgtggagaacgtggtccatggacaca

SEQ ID NO: 11757 - DNA, 361 bp, Homo sapiens; identical to SEQ ID NO: 3242

SEQ ID NO: 11758 - DNA, 536 bp, Homo sapiens
tgccagtgatctcagcaccaccagagagcttgttagaaatgcggcatcccaaccccaccacagccctcccaagtcagatactgccacctcacgaggccccccagggatccacaagttcattaaagtttcaggaatccaattctactacaaaatatacatttataattaggaaaaggatagtttcttttaaatggtagaacttccccaatgagtcagctacctgtatttctggcctgtcaggctagacactggagaccattctgcatagaattgtacctccctgaactactgttaggccttagggtggggattcatctttcccttctccccaccatggagacaaaatcctcttaaacatatccgggcctggcatggtggctcacgcctcggcctcccaaagttctgggattacaggcatgagccactgtgcccagccacccgtcacctgctagtgtagacaaatgaataaacttagacaagcacatgggctccctctataccagcctagactttgacactgaaactccatgagtctg

SEQ ID NO: 11759 - DNA, 951 bp, Homo sapiens
  misc_feature 583, 659, 682, 686, 720, 741, 746, 760, 770, 772, 784, 819,821, 824, 834, 842, 843, 848, 850, 856, 861, 869, 872, 879,894, 895, 906, 909, 910, 911, 914, 939: n = A,T,C or G
accctagggcaaatactgagcagggtaaaattcccagaatacccactagaagcgtggaatatatcaatatcctaggaagaagattcagcacaccaaatttcccattactgataacagctctgaaggcataataagaaagtgagtgatcagaagagcagagaaatgacttgttccagtcactgccatcttgtttaccctttcagtggttcccttacccttttccccactgggcatacagctcatctctctctgagtccttttctgctttcctcctttgctctaaacgttcgagtttcaaattcctcttacgaccagacttatctcgaaatacggtttcagcatattgaaattcagctgcaaaggaaaattatactcaaatatcaggatcaaaatcagaaataacattctaagagatcaaatcaaccgcttgggattctaatgctagataagaacttctgcagccagaccaaagtagttcctaccaacatcttggtgcatattggcactgggcccaagaaatggcattttccttttttttttttttgagatggagtctcactctgttgcccaggttggagtgcantgggcgcgattttggctcactgcaacctccacctcccaaggttcaagcgattctcctgtctcaagcctcctgagtnagctggggaatacagggcatacnacancatgcctggctagttttttttttggaattttggntagagacaggggtttcatcanggttngcccaggcctggtncttggaactnanagaccctcaggntggattcaacccaacttccgggctaccaaaaggtngncgngggattacangcatttanncaacngngccctngggcnaaaatggnaanttttcangaagggaaagcagcnntggggatcccnggnnnaantttcaccaaggccttaaaccagggncgtaaatttgtt

SEQ ID NO: 11760 - DNA, 481 bp, Homo sapiens
ggcacgagccgaactctcccctcacgctgatttcggatcgtagagggtcctcatttaccctctgcacttcttaggacattaactccagggaccgcagcggcccacgggccacccgcatagacgggagcggagaggagataagatggcggcccagctgcgcagacaccatgggcggcgaggggcgagctctccccggtgtgtgacagtgggggctattttcgaccatcccattttcgctgatggtttctaaatctctgcatttctgtccctcttagctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagc

SEQ ID NO: 11761 - DNA, 383 bp, Homo sapiens
  misc_feature 330, 369: n = A,T,C or G
ggttcttccataaatatagaaataatatatttttcttaaaggatatatttttaattatgtggaagttgtaagcttgaaattttaacttctagtgcttttctaaaattcacaattacaagtttaaaacatttcttctcttccaggtttcatttggaataaagagttggcagttatataaagcacttaataatactatagaaaatagatgtgttttttcttaatatgattttggtattttccacagatcagaagtgtaaacagagagataatgtaacagtatttggaagagataatgacacaaggatatagtgatctgggagcatgaattanaaacggggtactatgtttctggtgtaaaatctaaattgngctttctactagcg

SEQ ID NO: 11762 - DNA, 413 bp, Homo sapiens
  misc_feature 334, 362, 394: n = A,T,C or G
gctggagctgaagccaacctcccgagcaggcatcaaacagaaaggccttttgctaagtagcagcctgatgcactccgagtcagagctggacagcgacgatgccatctttacatggccagaccgagagaagggcaaactcctgcatggtcagaatggctctgtacccaacgggcagacccctctgaaggccaggagcccgcgggaggagatcctgtagccacctggtctgtctcctcagggcagggcccagcacactgcccggccagtcctcctacctccgagtctgcgggcagctgctgtcccagcatctgctgggcatttcgccctgacagtnccaaccagaacccctgggactttgaatncagaaacgttcttcaggaaccccttaacgaanctgtgaatgaaaaaggttc

SEQ ID NO: 11763 - DNA, 395 bp, Homo sapiens
ggcacgagtggtgctgctgctatgagctgcaccatcgagaagatcctgacagacgccaagacgctgctggagaggctacgggagcacgatgcggccgccgagtcgctggtggatcagtcggcggcgctgcaccggcgggtagcagctatgcgggaggcggggacagcgcttccggaccagtatcaagaggatgcatccgatatgaaggacatgtccaaatacaaacctcacattctgctgtcccaagagaacacacagattagagacttgcaacaggaaaacagagagctatggatttccttggaggaacaccaggatgctttggaacttatcatgagcaaatatcggaaacagatgttacagttaatggttgctaaaaaagcggtggatgctga

SEQ ID NO: 11764 - DNA, 552 bp, Homo sapiens
ggcacgagcagataccagctttctgactcctgctctaggattctcaccacgtactggctagacttatacttctcaaatcttaatttcctaaaggccggtcatgcccaacatggtcttcattggaggtatcaactgtaagaagaggaaagacttgtctcaggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgac

SEQ ID NO: 11765 - DNA, 538 bp, Homo sapiens
gccaaaggatgaagctagtgaaggagaaaaagcttaaattccatcttgagctcttggattgtgataatacaatgatttcattaacttttcatttctgtatacctgttcatttggaatttaatgcttgacttctttgttcattttggatctaaacttctcttttcttccttccccattcacatctattagaagactgcatcaccatttctttggcccccttactctgttgtcctttcccttttctttcagtttttttaatcgcatgtctagtatattaagtctccatagccctcctgatgcagtagacagtgctatgctgtggatataataccaaccagaaattggcatttataaacctgttaagagactttaagcatgcttcaagaggcagttgacccactggaatttctataaggctggtacccttcccagagttacagaatcttaggtgccgtctctagtctgtgagggaggaactcccagcatccccattgcccacaaatggaatcctcactgtatccactaggagattagaaat

SEQ ID NO: 11766 - DNA, 529 bp, Homo sapiens
taacagggtccttaggagaccatcagaaagaggaagggcctggtacaaaggttctccaaaacatcctatcggaaaaactcaattactaccaacaagtaaacctgtagatttgtaattggtaaatgttatacttgtcattaatgtaaataaagtgagtaattggtatgacttgcaggatgatgtacatgttagtttgtagctcaggatgattgttaagcaatagatttgctctattgaaaatgtttcatttttttcactgtacaagcaacttagatttttatttgtacaaattacttctttgtttttcttaatgatggcaatttttaaactttaattttattgtgatctcttaaagcagaggttagactttacctttctgactctgtcgtccaggctggagtgcagtggcgcaatctcactgcaagctccacttcctgggttcatgccattttcctgcctcagcctcccgagtagctgggactacaggtgcccgccaccacgcccagctaattttttgtatttttagtag

SEQ ID NO: 11767 - DNA, 537 bp, Homo sapiens
ttccgttgctgtcggatggcggtgtgcatcgcggtgattgccaaggagaattaccccctctacattcgcagcacccctacggagaacgagctgaagttccactacatggtgcacacatctctggacgtggtggatgagaagatctccgcaatggggaaggccctggtcgaccagagggagctgtacctgggcctgctctaccccacggaggactacaagatacggctacgtcaccaactccaaggtgaagtttgtcatggtggtagattcctccaacacagcccttcgagacaacgaaattcgcagcatgttccggaagctacacaactcctacacagacgtgatgtgcaaccccttctacaacccgggggaccgcatccagtccagggcctttgataacatggtgacgtcgatgatgatacaggtgtgctgagtgagctgtgctgccagccatcgcagaggagcccgcgcacgactgtggtggggccgtcggtctgttctggttgcctcttcctgaatgggacgcctggggctttc

SEQ ID NO: 11768 - DNA, 570 bp, Homo sapiens; identical to SEQ ID NO: 508

SEQ ID NO: 11769 - DNA, 512 bp, Homo sapiens
ttccgttgctgtcggctttgggaaaccgtgctcgccccagcaggtgctgacttcatctcccacctagcagcaccgttctgtgcacaaaacccagacctgttagcagacaggccccgtgaggcaatgggagctgaggccacactcagcacaaggccatctgggctcctccagggtgtgtgctcgccctgcggtagatgggagggaggctcaggtccctggggctagggggagccccttctgctcagctctgggccattctccacagcaaccccaggctgaagcaggttcccaagctcagaggcgcactgtgacccccagctccggcctgtcctccaacaccaagcacagcagcctggggctggcctcccaaatgagccatgagatgatacatccaaagcagacagctccaccctggccgagtccaagctgggagattcaagggacccatgagttggggtctggcagcctcccatccagggcccccatctcatgcccctggctgggacgtggct

SEQ ID NO: 11770 - DNA, 298 bp, Homo sapiens; identical to SEQ ID NO: 332

SEQ ID NO: 11771 - DNA, 519 bp, Homo sapiens
ctttaaaataaaggacttccttgaaaaagctaaggatatctttattgaacctcacctttgtctaaataactcaaaccatgaccgacttcataccttggtaactgaacactgttttccagacatgacttgggacatcaaatataagaccgtccgctggagctttgtggaatctttagagccctctcatgttgttcaagttcgctgttcaagtatgatgaaccagggcaacgtgtacggccagatcaccactctggccatctatgaccggtttggccggttgatgtatggacaggaagatgtacccaaggatgtcctggagtatgttgtattcgaaaagcagttgacaaacccctatggaagctggagaatgcataccaagatcgttcccccatgggcaccccctaagcagcccatccttaagacggtgatgatccctggccctcagctgaaaccagaagaagaatatgaagaggcacaaggagaggcccagaagcctcagctagcctgatgacaaaaatg

SEQ ID NO: 11772 - DNA, 234 bp, Homo sapiens
aaaaaagattatcacaactatcaaacgttattcgaaccaagaacacaccatccatatctcttggaaatgcttctagctccggacattcgacatgaaagaaatgtgattttgcagtgtgttcggtacatcatcaaaaaagacttttttggactggatactaattctgcgaaaagtaaagatgtataggcatctggtgtttcagcatacataactgaagcatgtgaaacagtatca

SEQ ID NO: 11773 - DNA, 161 bp, Homo sapiens
ctggcaagcacggccacgccaaggtccatctggctgggcttgacatctttactgggaagaaatatgaagatatctgcccgtcaactcataatatggatgttcccaacatcaaatagaatgacttccagctgattgccatccaggatgggtacctatcactg

SEQ ID NO: 11774 - DNA, 764 bp, Homo sapiens
  misc_feature 26, 28, 35, 305, 419, 464, 480, 563, 574, 585, 604, 614,630, 644, 647, 692, 696, 699, 724, 729, 762: n = A,T,C or G
tcactactcagcttttggctctgtgntntagtggnttcgggccatcaaaatgggaagatacgaagaaagtttcgcagccgctggctttggctccttcgagctggtcagccagatctctgctgaggacctgctccgaatcggagtcactctggcgggacaccagaagaaaatcttggccagtgtccagcacatgaagtcccaggccaagccgggaaccccgggtgggacaggaggaccggccccgcagtactgacctgcaggaactccccaccccagggacaccgcctccccattttccggggcanagtggggactcacagaggcccccagccctgtgccccgctggattgcactttgagcccgtggggtgaggagttggcaatttggagagacaggatttgggggttctgccataatangaggggaaaatcaccccccaccacctcggggaacttcagaccaanggtgagggcgcctttncctcaagactgggtgtgaccagaggaaaaggaagtgcccaacatcttccaaccttcccaagtgcccccctcaccttgatgggngcgttcccgcngaccaaaaaanagtgtgacttcccttgccngcttccaaantgggggggggcttgtncccagggggcaaanaangggtgttaagggccccatgaccaaaaacaattggggtttggtggncccnaanttggtggttgtcaccaccaaacttnaatanttttttttcccttgtaaatgccccttcccccantg

SEQ ID NO: 11775 - DNA, 491 bp, Homo sapiens
ttccgttgctgtcgggactttctgaagaccttttcccccgatgtcttccggttcttctgcctgcggagcagctaccgctcagccatcgactacagtgacagcgccatgctccaagctcagcagctgctcctggggctgggctctttcctggaggacgcacgtgcctacatgaaggggcagctggcctgcggctccgtcagggaagcgatgctgtgggagaggctctccagcaccaagagggccgtgaaggcggccttggcagatgattttgacacacccagggtggttgatgccatcctgggccttgcacaccacgggaatggacagctcagggcgtccctgaaggaacctgaagggccgagaagtcctgctgtgtttggtgccatcatctcttactttgaacagttttttgaaactgttggaatttctctggcaaatcaacagtacgtttcaggagacggcagcgaggctaccttgcatggtgtggtgga

SEQ ID NO: 11776 - DNA, 391 bp, Homo sapiens
cgttgctgtcgctccttctgatcttcaaacaagagagagaccttgaatacactgactcttccaccctttttttttctgggaaaggagagcaagaggtcccgagtcccctcctagtctttcatcctgaatttgcacagaggaaagcgggtgcccggcatggccatcctgatgttgctggcgggatccccatgcaccttgtccttctccactgatactggcagctcggctcctggacccaagatcccttgagtggaattctgcagtgcaagagcccttcgtgggagctgtcccatgtttccatggtccccagtctcccctccacttggtggggtcaccaactactcaccagaagggggcttaccaagaaagccctaaaaagctgttgacttat

SEQ ID NO: 11777 - DNA, 397 bp, Homo sapiens
  misc_feature 397: n = A,T,C or G
cgttgctgtcgcgacctgcttctgggtcggggtttcgtacgtagcagagcagctccctcgctgcgatctattgaaagtcagccctcgacacaagggtttgccgttgctgtcgctagcagtggaagaagactgaatatctcgtataccagaaacatgactcttaaagatggtaaaaacaatgtagccatagctgtaacgtataaccatgatgggtcttatagcatgcagattgaagataaaactttccaagtccttggtaatctttacagcgagggagactgcacttacctgaaatgttctgttaatggagttgctagtaaagcgaagctgattatcctggaaaacactatttacctattttccaaggaaggaagtattgagattgacattccagtcn

SEQ ID NO: 11778 - DNA, 78 bp, Homo sapiens; identical to SEQ ID NO: 511

SEQ ID NO: 11779 - DNA, 472 bp, Homo sapiens
cgcccatatccagaagggcttcaactacacggtgtttgactattgaaaaggccaaacctattaaatgtggaacatttggtgcaacatctttacagcagagatatttagctactggagattttggtggaaaccttcatatatggaatttagaagctccagagatgccagtatattctgtaaagggccataaagaaattataaatgccatagatggcataggtggactaggaattggagaaggagcacctgaaattgtgactggcagccgagatggaactgtgaaggtgtgggacccaaggcaaaaagatgatcctgttgctaatatggaacctgtacaaggagaaaacaagagagactgttggactgtggcatttggcaatgcttataatcaagaagaacgtgttgtttgtgctgctatgacaatggggatatcaaactatttgatctcagaaatatggcattacggtgggag

SEQ ID NO: 11780 - DNA, 555 bp, Homo sapiens
ttttcctggtttcggaccccagcggccggatggtgaaatcctccctgcagcggatcctcaatagccactgcttcgccagagagaaggaaggggataaacccagcgccaccatccacgccagccgcaccatgccgctcctaagcctgcacagccgcggcggcagcagcagtgagagttccagggtctccctccactgctgtagtaacccgggtccggggcctcggtggtgctcctgatgcccctcacccacccctgaagatcccaggtgggcgagggaatagtcagagggatcacaatctttcagctaacttattctactccgatgatcggctgaatgtaacagaggaactaacgtccaacgacaagacgaggattctcaacgtccagtccaggctcacagacgccaaacgcattaactggcgaacagtgctgagtggcggcagcctctacatcgagatcccgggcggcgcgctgcccgaggggagcaaggacagctttgcagttctcctggagttcgctgaggagcagctgcgagccgaccatgtcttcatttgc

SEQ ID NO: 11781 - DNA, 474 bp, Homo sapiens
tctcctacaagctggtgaagacgggcagcgtggtcctcacagccagcactgatctccgcggctatgtggtggggcaggcactgcagctgcatgccgacgttgagaaccagtcaggcaaggacaccagccctgtggtggccagtctgctgcagaaagtgtcctataaggccaagcgctggatccacgacgtacggaccattgcggaggtggagggtgcgggcgtcaaggcctggcggcgggcgcagtggcacgagcagatcctggtgcctgccttgccccagtcggccctgccgggctgcagcctcatccacatcgactactacttacaggtctctctgaaggcgccggaagctactgtgaccctcccggtcttcattggcaatattgctgtgaaccatgccccagtgagcccccggccaggcctggggctgcctcctggggccccacccctggtggtgccttccgcaccacccc

SEQ ID NO: 11782 - DNA, 720 bp, Homo sapiens
  misc_feature 605, 719: n = A,T,C or G
ggcacgagaagctgtgctgtgctcaccagacactttgatcttggacttctcagcctccagaactatggggttctgctcttgtcacccagactggagtgaagtggcacaatctcggctcactgcaacctccgcctcccgggttcaagcgattcccctgcctcagcctccagagtagctggactgcaggcgcacgccaccactcctggctaatttttgtatttttagtagagacggggtttcaccatgttggccaagatgttcttgatcttctcaccttgtgatccgcccacctcaacctcccaaagtgctgagagactaagacacctttctagacagagaggaggccgatggcagacattctcagataggtttgtagctattgacctggctgcatcaaaggagatgaaatcccttagaaattgacagcttctatgaaatttacaatcaagaaggcataagaacaactgctgcagcttcagaactatgcagaaaataaaatgtcaacagctgggagaaaaaattctaagtgagcaacagagccagtgaaaaatatcaccagtaggagcaggcacctgagacagggaaatggcacccactaagtgcangtctacaggggctgaccttgcagaccatttatggatcccaagttaccaaaacccttatttgattatgaactgcatagtagataccaatacatcagaacattggcttaatggttna

SEQ ID NO: 11783 - DNA, 455 bp, Homo sapiens
cggcaggagaagatggcgaccgtgtgggatgaggcccgagcaagatggaattggggaggaggtgctcaagatgtccacggaggagatcatccagcgcacacggctgctggacagtgagatcaagatcatgaagagtgaagtgttgagagtcacccatgagctccaagccatgaaggacaagataaaagagaacagtgagaaaatcaaagtgaacaagaccctgccgtaccttgtctccaacgtcatcgagctcctggatgttgatcctaatgaccaagaggaggatggtgccaatattgacctggactcccagaggaagggcaagtgtgctgtgatcaaaacctctacacgacagacgtacttccttcctgtgattgggttggtggatgctgaaaagctaaagccaggagacctggtgggtgtgaacaaagactctatctgatcctggagacgct

SEQ ID NO: 11784 - DNA, 455 bp, Homo sapiens; identical to SEQ ID NO: 3262

SEQ ID NO: 11785 - DNA, 715 bp, Homo sapiens
  misc_feature 375, 393, 460, 463, 468, 613, 633, 634, 650, 661, 676: n = A,T,C or G
ggcacgaggaacagtcagtttaactttttaacagatcttatttttttattttgagtgccactattaatgtaaaaaggggggggctctacagcagtcgtgatgaaacttaaatatatattctttgtcctcgagattttaggaagggtgtagggtgagtaggccatttttaatttctgaagtgctaagtgtttttatacagcaaacaaaaagtcaattttgctttccaccactgcgagagaggatgtatacttttcaagagagatgattgcctatttaccgtttgacagagtcccgtagatgagcaatggggaactggttgccagggtctaaatttggattgatttatgcactgttatctgttttgacacagatttncttgtaaaatgtgcctantttaccaaaattaacaaagggggggaaaggaccttagaactttttaaggtaaaatcaaatatagctncancatangagaatcgagaaatttgatagaggtaacttgtttaatgtaaatctaatagtacttgtaattttctttctgcttagaatctaaagatgttgtttagaacctcttgtttaaaaaataaataagactgcttatcataaaaatcacatntcacaccattttgaggcagnnggtcaaacaggtaaancctatgatgtntgtcatttttaaagnggtcggaaatttaaccctctggaatacccttctccattg

SEQ ID NO: 11786 - DNA, 546 bp, Homo sapiens; identical to SEQ ID NO: 3265

SEQ ID NO: 11787 - DNA, 538 bp, Homo sapiens; identical to SEQ ID NO: 515

SEQ ID NO: 11788 - DNA, 492 bp, Homo sapiens
ggcttagcggataacaatttcacacaggatgatgctaccactgtactgtcgcgtgccattgctgagctgggcatctatccagctgtggatcctctagactccacctctcgtatcatggatcccaacattgttggcagtgagcattacgatgttgcccgtggggtgcaaaagatcctgcaggactacaaatccctccaggatatcattgccatcctgggtatggatgaactttctgaggaagacaagttgaccgtgtcccgtgcacggaaaatacagcgtttcttgtctcagccattccaggttgctgaggtcttcacaggtcatatggggaagctggtacccctgaaggagaccatcaaaggattccagcagattttggcaggtgaatatgaccatctcccagaacaggccttctatatggtgggacccattgaagaagctgtggcaaaagctgataagctggctgaagagcattcatcgtgagggggcttt

SEQ ID NO: 11789 - DNA, 89 bp, Homo sapiens
ccactgttcaaggtttattgggggttttagttggtataacacttggatagtgggttgcattgtttgtatgtaaatctttttacattata

SEQ ID NO: 11790 - DNA, 358 bp, Homo sapiens
ggcttagcggataacaatttcacacaggatgatgctaccataatcatcgctatccccaccggcgtcaaagtatttagctgactcgccacactccacggaagcaatatgaaatgatctgctgcagtgctctgagccctaggattcatctttcttttcaccgtaggtggcctgactggcattgtattagcaaactcatcactagacatcgtactacacgacacgtactacgttgtagctcacttccactatgtcctatcaataggagctgtatttgccatcataggaggcttcattcactgatttcccctattctcaggctacaccctagaccaaacctacgccaaaatccatttcacta

SEQ ID NO: 11791 - DNA, 491 bp, Homo sapiens
ggcttagcggataacaatttcacacaggatggattggtcctagcctttctattagctcttagtaagattacacatgcaagcatccccgttccagtgagttcaccctctaaatcaccacgatcaaaagggacaagcatcaagcacgcagcaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctccccaataaagctaaaactcacctgagttgtaaaaaactccagttgacacaaaatagactacgaaagtggctttaacatatctgaacacacaatagctaagacccaaactgggattagataccccactatgcttagccctaaacctcaaca

SEQ ID NO: 11792 - DNA, 625 bp, Homo sapiens; identical to SEQ ID NO: 2754

SEQ ID NO: 11793 - DNA, 539 bp, Homo sapiens
tcgaaaatcagttatttaacccaatttacttgtgaaagaagttttatctttatggactatgatgacttttgacatcaccatttcttgaagaccttggtattaaatgcatgagaaaccttttgccatctagaaatttctaagtttgtttatgttataagactgtaattaattgatagggaatttgggatctcaatccggggctttttgaaatcagatcattaaatatctcgtcactttggggacttgttatttttaactatgatgtggatatcctgttttaattatgaagtctagaattggtacatatgttgtatgctttgtaaagaatttcacttggtctaatttattgcatatactagcttctgttggaaaatgactgacagctagaaagtttaaggtaatttctaagtatactacctataagtaactgataagaattaggcatcattcagtgatatagcagatgactaatgggtttttcaggccctgcacttctctttcccattttcctgttgcattcagcctcttcaatgcttagt

SEQ ID NO: 11794 - DNA, 364 bp, Homo sapiens
ccgttgctgtcgggcaatctccatggctacgtggctgagggtggagccaatgacatccgaggtgctgtggaggccgctcaccaggctttccctggctgggcgggccagtccccaggagcccgggcagccctgctgtgggccctggcggctgcactggatcgccggaagtctaccctggcctctaggctggagaggcacggagcggagctcaaggctgcggaggcggatgtggagctgatcgcaagacgacttctggcgtggggggcccgggtgcaggcccaaggccacaccctgcaggtagccgggctgataggccctgtgctgcgcctgcgggagccgctgggtgtgctggctgtggtgtgtc

SEQ ID NO: 11795 - DNA, 118 bp, Homo sapiens
cgttgctgtcgggacacttgagcccagagttcaaggctgcaatgagccatgatgacaccacggcactacaaccttggtggcacagtgagaacctgactcttaaaaaaaaaaaaaaagg

SEQ ID NO: 11796 - DNA, 527 bp, Homo sapiens; identical to SEQ ID NO: 3273

SEQ ID NO: 11797 - DNA, 511 bp, Homo sapiens
ctggggagaaggggagctgtgatggaggctcgctctgttgccaggctggagtacagcgatctcggctcactgcaacctctgcctcccgggttcaagtgattctcctgcctcagcctcccaagtagctgggactacaggctctttaagggtcacccagagactctggagaagtttgacaagttcaagcacctgaagtcagaggacgagatgaaggcatctgaggacttaaagaagcatggtgccactgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcctccaactacaaggagctgggcttccagggctaggccc

SEQ ID NO: 11798 - DNA, 179 bp, Homo sapiens
tagcactaggtccatctgaatgggtggcccacgacatggttatggtcccctcccctccgatctgattctcaaagatgcaggctagcccctggcactgccctgcctctgttcctgtctcctcaaccctggctctgctcccagaccataccccgaccttggccctgctgctaccctgcctc

SEQ ID NO: 11799 - DNA, 255 bp, Homo sapiens; identical to SEQ ID NO: 3275

SEQ ID NO: 11800 - DNA, 90 bp, Homo sapiens; identical to SEQ ID NO: 2653

SEQ ID NO: 11801 - DNA, 482 bp, Homo sapiens; identical to SEQ ID NO: 3278

SEQ ID NO: 11802 - DNA, 227 bp, Homo sapiens; identical to SEQ ID NO: 3279

SEQ ID NO: 11803 - DNA, 204 bp, Homo sapiens
gctttgaatagctggctccgatgctgatggggctggacctgttggtgttcaaccaccatcatgtcggccacggtcatatcgaaggggacaggatggtagagtctgacttacacgttttcaacagggatgtgttgcaacatgtggatttcatgcagaaagactaccctgggcttactgtcttccttctgggccactccatgggag

SEQ ID NO: 11804 - DNA, 515 bp, Homo sapiens
gaatttaaggcaaaaaaggtggagagggagatgtgtgagcatcctgcaaggtgaaacaagactcaaaatgacagtttcagagagtcaatgtcattacatagaacacttcggacacaggaaaaataaacgtggattttaaaaaatcaatcaatggtgcaaaaaaaaacttaaagcaaaatagtattgctgaactcttaggcacatcaattaattgattcctcgcgacatcttctcaaccttatcaaggattttcatgttgatgactcgaaactgacagtattaagggtaggatgttgcttctgaatcactgttgagttctgattgtgttgaagaagggttatcctttcattaggcaaagtacaaaattgcctataatacttgcaactaaggacaaattagcatgcaagcttggtcaaactttttccagcaaaatggaagcaaagacaaaagaaacttaccaattgatgttttacgtgcaaacaacctgaatcttttttttatataaatatatattt

SEQ ID NO: 11805 - DNA, 214 bp, Homo sapiens
atgtgcgacaaggagttcatgtgggccctgaaaaacggagacttggatgaggtgaaagactatgtggccaagggagaagatgtcaaccggacactagaaggtggaaggaaacctcttcattatgcagcagattgtgggcagcttgaaatcctggaattcctgctgctgaaaagagcatatattaatgctccagataaacatcatattactcctc

SEQ ID NO: 11806 - DNA, 389 bp, Homo sapiens
  misc_feature 389: n = A,T,C or G
cgttgctgtcggatcggcttgccaaaggatcagaatgttaccaaaagagccttagtttaaatcctttcctctggtctccctttgaatcattatgtgaaataggtgaaaagccagatcctgaccaaacatttaaattcacatctttacagaactttagcaactgtctgcccaactcttgcacaacacaagtacctaatcatagtttatctcacagacagcctgagacagttcttacggaaacaccccaggacacaattgaattaaacagattgaatttagaatcttccaattcaaagtactccttgaatacagattcctcagtgtcttatattgattcagctgtaatttcacctgatactgtcccactgggaacaggaacttccatattn

SEQ ID NO: 11807 - DNA, 575 bp, Homo sapiens
aagcagcagggaaaacctggcgctgcaaaatgtgcaggctcgaatacggatggtcctcgcctatctgtttgctcagttgagcctctggtctcggggtgtccacggtgggctcctcgtgctgggatccgccaacgtggatgagagtctcctgggctacctgaccaagtacgactgctccagtgcggacatcaaccccataggcgggatcagcaagacggacctcagggccttcgtccagttctgcatccagcgcttccagcttcctgccctgcagagcatcctgttggcgccggccaccgcagagctggagcccttggctgatggacaggtgtcccagaccgacgaggaagatatggggatgacatatgcggagctctcggtctatgggaaactcaggaaggtggccaagatggggccctacagcatgttctgcaaactcctcggcatgtggagacacatctgcaccccgagacaggtcgctgacaaagtgaagcggtttttctccaagtactccatgaacagacacaagatgaccacgctcacacccgcgtaccacgccgagaactacagccctg

SEQ ID NO: 11808 - DNA, 519 bp, Homo sapiens; identical to SEQ ID NO: 3281

SEQ ID NO: 11809 - DNA, 511 bp, Homo sapiens; identical to SEQ ID NO: 3282

SEQ ID NO: 11810 - DNA, 503 bp, Homo sapiens; identical to SEQ ID NO: 3284

SEQ ID NO: 11811 - DNA, 591 bp, Homo sapiens; identical to SEQ ID NO: 3285

SEQ ID NO: 11812 - DNA, 624 bp, Homo sapiens
attccgttgctgtcggctgaatgttcatgatcattatcagaacatgaaacatgtaatttcagttgataagtccaagccagataaagccctcagcttgataaaggatgatttttttgacaatattaagaacatagttttggagcatcagcagtggcacaaagacagaaagaatccatccttaaagtcaaaaactaatgatggagaagaaaaaatggaaggaaattcacaagaaacggagagatgtgaaagggcagaatcattagcgaaaataaaatcaaaggccttttcagttgtcatacaggcatccaaatcaagaaggcatcgtcaagtcaaactcgactcttctgactctgattctgcatctggtcaagggcaagtcaaagcaactaggaaaaaagagaagaaagaaagattgaaaccagcaggaaggaagatgtctctcagaaacaaaggcaatgtgcagaatatacacaaggaagataaacctttaagtctgagtatgcctgtaattacagaagaagaagagaatgaaagtttgagtggaacagagttcactgcatccaagaagaggagaaaacactgaacaaagagcctggtgtagtttttaattttgagttttctgac

SEQ ID NO: 11813 - DNA, 300 bp, Homo sapiens
  misc_feature 75, 243, 291: n = A,T,C or G
atttattccacttcttgtatggcctgaagaatctaggaggagaaaaagccagataccaaacttacggccaggcanacgggtcgcgggtgttgacagggtcctgagggagtttgaagccttattctcgagccgcctcctcttctctacccacacttgcaccgaggtcaccccggcaccctccgcaccggttcggttttggtctctgcttgtcctctcagtccttggtactttcgtctccctcanccggaggtggcaaactcagacatctacgggcgcccgaggccctcgcanccctgagcc

SEQ ID NO: 11814 - DNA, 128 bp, Homo sapiens
cctccaccgacctctgcccaccatgggttggaactaaactgttaccttccctcgctccacacaagaagacagcctgcttcaggggtccctgtgctggccaagccactgagcctgcggggaggctggtc

SEQ ID NO: 11815 - DNA, 464 bp, Homo sapiens
tccgttgctgtcgggatgtttacagacaagttcattccattattagacgttccctgccagcaacactaccacagtgtcaggcagcgaacaagacctgccccaccaattacatgtggaataatcacatctgcagatgcctggctcaggaagattttatgttttcctcggatgctggagatgactcaacagatggattccatgacatctgtggaccaaacaaggagctggatgaagagacctgtcagtgtgtctgcagagcggggcttcggcctgccagctgtggaccccacaaagaactagacagaaactcatgccagtgtgtctgtaaaaacaaactcttccccagccaatgtggggccaaccgagaatttgatgaaaacacatgccagtgtgtatgtaaaagaacctgccccagaaatcaacccctaaatcctggaaaatgtgcctgtgaatgtacagaaagt

SEQ ID NO: 11816 - DNA, 366 bp, Homo sapiens
cctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggagccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttacgacagttacgctacacacaacgagtaaaaac

SEQ ID NO: 11817 - DNA, 399 bp, Homo sapiens
ggcacgaggtggttgaccgcttgcttcttgttattaccaaaacaggaggggaaaaaattaactgctccaaatttaaccataaatcaattcatgtttaacgtttctcattaaaatccagtattatattatcatatctctctttacttaccagtataagatttttgaaaatcctgaataaaccagtatcgttactggcacctgaaattaatttgtgaatttgcaacagtaatcagagttaccattatttaatttgtatgctaaatgaggaggtacattgaaaccctccaaatctccagtctcatctatgtcatattttgccactgcctttcagaagtgatttagttgtggaaagataataaattgatttgttatggttacatatttagcgcacccagagaa

SEQ ID NO: 11818 - DNA, 300 bp, Homo sapiens
cccgggtgaggggcggagctgggggcatggcgtccggagcggctcgctggctagtattggcacccgtcaggtccggggctctccggagcgggcctagcttgaggaaagatggcgatgtctccgccgcatggagcggctcaggccggagcctggtaccgtcgaggtcagtcatcgttacccgcagcggcgccattttgcccaaaccggtgaaaatgtccttcggccttctccgtgtgttctccattgtgatcccctttctctatgtcgggacactcattagcaagaactttgctgctctac

SEQ ID NO: 11819 - DNA, 555 bp, Homo sapiens
gtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggctgatggacgtctgtgccacatcccgaactgaccgggagatcaaggtaaccctggtgtttgagcatgtagaccaggacctaaggacatatctggacaaggcacccccaccaggcttgccagccgaaacgatcaaggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcacttacacccgtggttgttacactctggtaccgagctcccgaagttcttctgcagtccacatatgcaacacctgtggacatgtggagtgttggctgtatcttt

SEQ ID NO: 11820 - DNA, 561 bp, Homo sapiens
tgatgttcaagaaccaactgaaccagaggatgaccttgacattatgcttggcaataaaaagaagaaaaagaagaatgttaagttcccagatgaggatgaaatactagagaaagatgaagctctagaagatgaagacaacaaaaaagatgatggtatctcattcagtaatcagacaggccctgcttgggcaggctcagaaagagactacacatacgaggagctgctgaatcgagtgttcaacatcatgagggaaaagaatccagatatggttgctggggagaaaaggaaatttgtcatgaaacctccacaagtcgtccgagtaggaaccaagaaaacttcttttgtcaactttacagatatctgtaaactattacatcgtcagcccaaacatctccttgcatttttgttggctgaattgggtacaagtggttctatagatggtaataaccaacttgtaatcaaaggaagattccaacagaaacagatagaaaatgtcttgagaagatatatcaaggaatatgtcacttgtcacacatgccgatcaccggacacaatcctgca

SEQ ID NO: 11821 - DNA, 552 bp, Homo sapiens
cccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagaggtacaatttttttactggctgccccaaggccaagacatgcaccttcattctccgtggcggcgccgagcagtttatggaggagacagagcggtccctgcatgatgccatcatgatcgtcaggagggccatcaagaatgattcagtggtggctggtggcggggccattgagatggaactctccaagtacctgcgggattactcaaggactattccaggaaaacagcagctgttgattggggcatatgccaaggccttggagattatcccacgccagctgtgtgacaatgctggctttgatgccacaaacattctcaacaagctgcgggctcggcatgcccaggggggtacatggtatggagta

SEQ ID NO: 11822 - DNA, 521 bp, Homo sapiens
ggcacgagggccagacagacaatggggattatgcatctttgatgatgtcatagaacactgtagtccagcctcatttaaatacgcagaatatttcttaagaccaatgctccaatatgtatgtgacaacagcccagaagtcaggcaagcagctgcatatggcctgggagtcatggcacagtacggtggagataattatcgccctttttgtacagaagcacttcccctgctggtaagagttattcagtctgcggattctaagaccaaagaaaatgtcaatgctacagagaactgcatctcagcagtagggaaaatcatgaagttcaagcctgactgtgtaaacgttgaagaggtccttccacactggttgtcttggcttccactacatgaagataaagaagaagctgttcagactttcaattatctgtgtgacctgattgaaagtaatcatccaattgttcttggcccaaacaataccaatctgcccaaaatatttagtataattgcggaaggagaaatgcacg

SEQ ID NO: 11823 - DNA, 573 bp, Homo sapiens
ggcacgaggctgcgctggcgctgctgctcttcggcctgctgggtgttctggtcgccgccccggatggtggtttcgatttatctgatgcccttcctgacaatgaaaacaagaaacccactgcaatccccaagaaacccagtgctggggatgactttgacttaggagatgctgttgttgatggagaaaatgacgacccacgaccaccgaacccacccaaaccgatgccaaatccaaaccccaaccaccctagttcctccggtagcttttcagatgctgaccttgcggatggcgtttcaggtggagaaggaaaaggaggcagtgatggtggaggcagccacaggaaagaaggggaagaggccgacgccccaggcgtgatccccgggattgtgggggctgtcgtggtcgccgtggctggagccatctctagcttcattgcttaccagaaaaagaagctatgcttcaaagaaaatgcagaacaaggggaggtggacatggagagccaccggaatgccaacgcagagccagctgttcagcgtactcttttagagaaatagaagattgtcggcagaaaca

SEQ ID NO: 11824 - DNA, 485 bp, Homo sapiens
ggcacgaggctctttgtcctccaggccattggtatcccaggttggggattcagtggctggatctctgctctggtggtgccgaagggcaacacagcagtatccgtgctcatgctgctggtcgccctgctcttcactggcattgctgtgctaggaattgtcatgctgaaacggatccactccttataccgccgcacaggtgccagctttcagaaggcccagcaagaatttgctgctggtgtcttctccaaccctgcggtgcgaaccgcagctgccaatgcagccgctggggctgctgaaaatgccttccgggccccgtgacccctgactgggatgccctggccctgctacttgagggagctgacttagctcccgtccctaaggtctctgggacttggagagacatcactaactgatggctcctccgtagtgctcccaatcctatggccatgactgctgaacctgacaggcgtgtggggagttcactg

SEQ ID NO: 11825 - DNA, 442 bp, Homo sapiens
ggcacgagcggaggtccacttccgcagcatccggtccacggggagcaaacagcgcagccagaaccgctccaagacgcccaagaaccaggaagccctgcggatggccaacgtggcagagaacagcagcagcgaccagaggcaggcctgtaagaagcacgagctgtatgtcagcttccgagacctgggctggcaggactggatcatcgcgcctgaaggctacgccgcctactactgtgagggggagtgtgccttccctctgaactcctacatgaacgccaccaaccacgccatcgtgcagacgctggtccacttcatcaacccggaaacggtgcccaagccctgctgtgcgcccacgcagctcaatgccatctccgtcctctacttcgatgacagctccaacgtcatcctgaagaaatacagaaacatggtggtccgggcctgt

SEQ ID NO: 11826 - DNA, 384 bp, Homo sapiens
gcggtcgcgccggcaagagcagcgggagcggcgcggggaagggggcggtgtccgcagagcaggtgattgctggcttcaaccgccttcggcaggaacagcgaggcctggcatccaaagcagctgagttggagatggagttgaatgagcacagcctagtgatcgatacactgaaggaggtagatgaaactcgtaagtgctaccgcatggttggaggagtgctggtggagcgaactgtcaaagaggtgctgcccgctttggagaacaacaaggagcagatacagaagatcattgagacactgacacagcagcttcaggcaaagggaaaagaactaaatgaattccgggaaaagcacaacattcgtctcatgggagaagatgagaagc

SEQ ID NO: 11827 - DNA, 455 bp, Homo sapiens
taccggctgcgggaggcccaggaccgggcccgagcggaagaccttaatagccgagtctcttactggtctgttggcgagacgattgccctgttcgtggtcagcttcagtcaggtgctactgttgaaaagcttcttcacagaaaaacgacccatcagcagggcagtccactcctagccccggcatcctgctctagggcccctcatgccccaggctggagcagctctcctaggtcacagcctgctgggctgggtcgcgtagcccagggtggaggcagaacgatgctgctgtggtagccctttgcctttcatgcccatgcttgattcttgcacctcagcagctgaaggtctcagagaccagtaatcagaaggcatccgactgcattaagtgtgcagcgctgaaaagacatttacaactaggccagggattagccactgtgggagggtggacaggcaatg

SEQ ID NO: 11828 - DNA, 210 bp, Homo sapiens
caagggacactttaatggttaacttaagggatcatcaattttgcctcactacctacaaagggaatttcatcttgtccccatgctgagtagggaaacagggacaaagttaatcataataccctacatcaaaaaaaaactaagctaacactgctaactttttttttaacaggcaaaatataaatatatgccctctaaaatgcccaagggttt

SEQ ID NO: 11829 - DNA, 488 bp, Homo sapiens
gtcggaaaagaacatagagataggaagtcatctgactctgacagctcagactctgagagtgatacaggcaagagggcaaggcacacatcaaaagacagcaaggcagcaaagaagaagaaaaagaagaagaagcacaagaagaagcacaaggagtgagagtataaagagtgtagggggtggttgagagtaagaaaccaggagccttgtgccttgagactcctggaaagactcaatagtgagaatatagcctcccaccccattaacttcgctcccatgggagatggcttcccctcatgcaacaggcaggtttgggagttagaggtcaaaagcagctgcctgaatgagttgttgtttccttatcactcctggtccctttgcaagtgaaccctgcagctcacccattcattcacccaacttccttcattcagcaggaggtcctattaccctctccagctgccactgccagagctggattcctgtaaaggagt

SEQ ID NO: 11830 - DNA, 512 bp, Homo sapiens; identical to SEQ ID NO: 3291

SEQ ID NO: 11831 - DNA, 269 bp, Homo sapiens; identical to SEQ ID NO: 3292

SEQ ID NO: 11832 - DNA, 568 bp, Homo sapiens
ccgttgctgtcgggctgcctggccggtgctgttggggctgctgctggcgctgttagtgccgggcggtggtgccgccaagaccggtgcggagctcgtgacctgcgggtcggtgctgaagctgctcaatacgcaccaccgcgtgcggctgcactcgcacgacatcaaatacggatccggcagcggccagcaatcggtgaccggcgtagaggcgtcggacgacgccaatagctactggcggatccgcggcggctcggagggcgggtgcccgcgcgggtccccggtgcgctgcgggcaggcggtgaggctcacgcatgtgcttacgggcaagaacctgcacacgcaccacttcccgtcgccgctgtccaacaaccaggaggtgagtgcctttggggaagacggcgagggcgacgacctggacctatggacagtgcgctgctctggacagcactgggagcgtgaggctgctgtgcgcttccagcatgtgggcacctctgtgttcctgtcagtcacgggtgagcagtatggaagccccatccgtgggcagcatgaggtccacggcatgcccagt

SEQ ID NO: 11833 - DNA, 547 bp, Homo sapiens; identical to SEQ ID NO: 532

SEQ ID NO: 11834 - DNA, 487 bp, Homo sapiens
ccgttgctgtcgaaactgagccagtggccaaacaaccgtgctcagcctgtttctctctgccctctagagcaaggcccaccaggtccatccaggaggctctcctgacctcaagtccaacaacagtgtccacactagtcttagccaatattaaaacatactatgaagcctctgatacttaaacagcatggcgctggtacgtaaatagaccaatgcagttaggtggctctttccaagactctggggaaaaaagtagtaaaaagctaaatgcaatcaatcagcaattgaaagctaagtgagagagccagagggcctccttggtggtaaaagagggttgcatttcttgcagccagaaggcagagaaagtgaagaccaagtccagaactgaatcctaagaaatgcaggactgcaaagaaattggtgtgtgtgtgtgtgtgtgtgtgtgtgtgtgtgtgtataatttaaaaaaagtttttattgagatacaagt

SEQ ID NO: 11835 - DNA, 343 bp, Homo sapiens
ttcggcacgaggccaaacgtaccaagaaagtcgggatcgtcggtaaatccgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgt

SEQ ID NO: 11836 - DNA, 382 bp, Homo sapiens
gccgccagccagagggccgagagccgcggggagaaggccatcacccaggtcagcaagggcacctgcgagcaaggtccttccatagtgacgccccccaaggacatctggaatgtcactggtgcccaggtgtacttgagctgtgaggtcatcggaatcccgacacctgtcctcatctggaacaaggtaaaaaggggtcactatggagttcaaaggacagaactcctgcctggtgaccgggacaacctggccattcagacccggggtggcccagaaaagcatgaagtaactggctgggtgctggtatctcctctaagtaaggaagatgctggagaatatgagtgccatgcatccaattcccaaggacaggcttcagcatcagcaa

SEQ ID NO: 11837 - DNA, 224 bp, Homo sapiens
tttccttcttttttttttgaaacaggttctcactctgtcaccgaggttggagggcaggggaatgataatagctgactgcagcctcaaccttctgggctcaaaggatcctttcacctcagcctcctgagtagctgggaccacaggggggggccaccacaccgggctaattttaagggattttttttcctttttttttttacccatggtgcccagggtggacttgg

SEQ ID NO: 11838 - DNA, 353 bp, Homo sapiens
ctgtctcaagccaagctgtgaaaaccctagacgcacccgcagggagggtggggagagctggcaggcccagggcttgtcctgctgaccccagcagaccctcctgttggttccagcgaagaccacaggcattccttagggtccagggtcagcaggctccgggctcacatgtgtaaggacaggacattttctgcagtgcctgccaatagtgagcttggagcctggaggccggcttagttcttccatttcacccttgcagccagctgttggccacggcccctgccctctggtctgccgtgcatctccctgtgccctcttgctgcctgcctgtctgctgaggtaaggtgggaggaagg

SEQ ID NO: 11839 - DNA, 285 bp, Homo sapiens
cgggcaggtacaccctggacaagttagttaacctctctgagctggcttcctcgttgttcaacaatctccccaccttttttttttgaaatagagcctggccctgtcacccaagctggagggcaaaggctcaatcacagttcactgcagccttgacctcctgggctaaagcagtcctcccgcctcagcctcccaggtagctgggattacaggcacacaccactacaacaggctgttttgcatcttttgtaaacatgggttttaccgcgttgcccggcaggtctcaaa

SEQ ID NO: 11840 - DNA, 399 bp, Homo sapiens; identical to SEQ ID NO: 3294

SEQ ID NO: 11841 - DNA, 373 bp, Homo sapiens
ggccaggtgtttcgaggtaggcttgccttctggcagcatggactttgttaaaataataggcggaaagaagaggcctgggaagggcccccagtcttttggaatgtcctggtcacagggtcatgtcagctgccagttctcgtctcccgtcctggagttgctcggtcttgcggagctgcccgcctgcctgttctggcggctccagcgcaggctgtccctgctgctttgattccaggtgattttattttttttatttttttattttttttgagacggagtcttgctctgttgcccaggcaggagtgcagtggcgcatctcggctcactgcaacctctgtctcaagcgattctcctgcctcgcctcctgagtagctgg

SEQ ID NO: 11842 - DNA, 522 bp, Homo sapiens; identical to SEQ ID NO: 3295

SEQ ID NO: 11843 - DNA, 163 bp, Homo sapiens
gtgcggccctggggacccccccctccccgagtgtgcccaggaactcagagagggcgcggcccccggggattcccccccgagggtgcccaggactcggaaggggcgccccggactcgacaagctggaccccctgctcccgggggggcgagcgcatgaccccccc

SEQ ID NO: 11844 - DNA, 544 bp, Homo sapiens
cgttgctgtcggaaggactgcgggtgtgtgtgtgtatgtgtgtgtgtatgtgtgtgcgcgcgtgcgtgcgtgtgtgtgcgcgcgctagtgtgtggacaaggaggtgggggcagctgagttagagtcccaactcttggactccatttgctattctcttctttctcccccacacctatctggtggtggtagtgggcgtttatatttgcgttccttttcattcatttctaaatctcttaaaaattttgggttgggggtattggggaaggcaggaaagggaaaaggagagtagtatctgaagagcaagaggaggacatggagatgaagaagaagattaacctggagttaaggaacagatccccggaggaggtgacagagttagtccttgataattgcctgtgtgtcaatggggaaattgaaggcctgaatgatactttcaaagaactagaatttctgagtatggctaatgtggaactaaattcgctggcccggcttcccagcttaaataaacttcgaaaattggagcttagtgataatataatttctg

SEQ ID NO: 11845 - DNA, 452 bp, Homo sapiens
aatataataaaaaacccgcagtttgtgttcgacgtgcaaacatctgataacatggatgcggtgctccttgtcattgcacagaccttcatggacgcctgcaccctggccgaccacaagctgggccgggactccccgatcaacaaacttctgtatgcacgggacattccccggtacaagcggatggtggaaaggtactatgcagacatcagacagactgtcccagccagcgaccaagagatgaactctgtcctggctgaactgtcctggaactactccggagacctcggggcgcgagtggccctgcatgaactctacaagtacatcaacaagtactatgaccagatcatcactgccctggaggaggatggcacggcccacaagatgcagctgggctatcggctccagcagattgcagctgctgtggaaaacaaggtcacagatctataggaacc

SEQ ID NO: 11846 - DNA, 377 bp, Homo sapiens
  misc_feature 377: n = A,T,C or G
cgttgctgtcgagttgatgttgctctgggaatcctgattgagagccgcaaacaggaaaaggcctgcgagcagccggccctggcgggggctgataacccagagcactcccctccctgctccgtgtcgcctcacacaagttctgggagcagcagtgaggaagaggacagtgggaaacaggcactggctccaggcctcagcccttcccagaggccggggggttccagctctgcctgtagcaggagccctgaggaggaggaggaagaggatgtgctgaaatacgtccgggagatctttttcagctagggcataaactgtgcactgaactgtctgccgagagcagctggaggacagctgagcttccactggtgctgctgggn

SEQ ID NO: 11847 - DNA, 82 bp, Homo sapiens
aacgagactaaaaaaggcaaaagctgcagaaactagaaattcatctgaacaggaattaagaataactcaaagtgaatttgat

SEQ ID NO: 11848 - DNA, 382 bp, Homo sapiens; identical to SEQ ID NO: 3299

SEQ ID NO: 11849 - DNA, 203 bp, Homo sapiens
ccgttgctgtcgagaaaggaaactattgcaaaataagagactggatttggatgcgtgcggaaacgagactaaaaaaggcaaaagctgcagaaactagaaattcatctgaacaggaattaagaataactcaaagtgaatttgatcgtcaagcagagattaccagacttctgctagagggaatcagcagtacacatgcccatcac

SEQ ID NO: 11850 - DNA, 181 bp, Homo sapiens
caatgaccagaaagtgtgtgcctcccaaaagccgcccaaagacctgggctacatctacttctaccagagagtggccagctaagagcctgcctgaccccttaccaatgagggcaggggaagaccacctggcatgatggagaggggctgacggatggacttcagcccctctggtctgaaccct

SEQ ID NO: 11851 - DNA, 388 bp, Homo sapiens
gcattgctactacgagctaccttctacctgcttattggcaatgccaatgcagccaaaccagatttagataaagtcatcagtttgaaagaagctaatgtgaagcttcgagcaaatgctctcatcaaaagaggcagcatgtacatgcaacagcagcagcctttgctgtccactcaagattttaacatggctgctgacatcgatcctcagaatgcagatgtttatcaccaccgaggacagctgaaaatactccttgatcaagttgaagaagcagtggcagattttgatgaatgtattaggttaagacctgagtctgctctggcacaagcacagaaatgttttgcattgtaccgccaggcatatacgggaaacaactcttcacaaatccaag

SEQ ID NO: 11852 - DNA, 356 bp, Homo sapiens; identical to SEQ ID NO: 3300

SEQ ID NO: 11853 - DNA, 646 bp, Homo sapiens
ttccgttgctgtcgatacctgcaactgaggattcttcccggggagaccgcagcccatcggcatggctcaagagtttgtgaactgcaaaatccagcctgggaaggtggttgtgttcatcaagcccacctgcccgtactgcaggagggcccaagagatcctcagtcaattgcccatcaaacaagggcttctggaatttgtcgatatcacagccaccaaccacactaacgagattcaagattatttgcaacagctcacgggagcaagaacggtgcctcgagtctttattggtaaagattgtataggcggatgcagtgatctagtctctttgcaacagagtggggaactgctgacgcggctaaagcagattggagctctgcagtaaccacagatctcataggaaatgttcaacaattctgtgaaaggtcacaggacccaattggagaaatcatatgaaaagcatagttggtcttggtgtcatatggatcagaggcacaagtgcagaggctgtggtcatgcggaacactctgttatttaagatggctatccagataatcctgaacactgtgtatttattttatttagactaccagcaaagattaaagcatgaaatgtaaaacatctgataaaacttacagccccctacacc

SEQ ID NO: 11854 - DNA, 648 bp, Homo sapiens
  misc_feature 384, 489, 490, 491, 493, 495, 496, 497, 499, 502, 527, 532,545, 547, 562, 570, 575, 579, 594, 599, 603, 606, 620, 637,645, 647: n = A,T,C or G
ggcacgagctcatgcctgtaatcccagcactttgggaggctgaggcgggtggatcacctgaggtcaggagttcaagaccagcctgaccaacatggagaaaccccgtctctactaaaagtactaaaaaattagccgggtgtggtggcgtgtgctggtagtcccagctacttggggggctgaggcaggagaattgtttgaacccgggaggtggaggttgcagtcagccgagatagtgccactgtactccagcctgggcgacagagtgagactgtactccagcctgggcgacagagtgagactccatctcaaaaaataataaaataaaataaaataaataaataaataaaatagaagggagagacttacgtcagaacttcccacctncccaccacatgccacagaacaaggctttaaggagctatttctgctgttcttccccctcccatattaaataaaaaggtgtgttctgcaggtaggaaaaaaaaaaannnancnnnantgnaaaaaaaaacccggccctttaaaanttttnggggggccttttncnaaatcccacctgatnaaaaaccnttggngaanttggggaaaaccccnacttnaaangcngggaaaaaaaagcntttttttgggaaaattngggaggcntnt

SEQ ID NO: 11855 - DNA, 370 bp, Homo sapiens
acagaaaaactttctatttgtacgactttgggataggaatatggacatagctatgggctggaagggtgcccacgccatgcagttgggacaacctttggttattgacatggcttacgaaaattatatgacacgaaaagaattgcggaatactgtttcccagcttttagaaagtgaaggatggaacacaagaaatgttgatcctttccatatttatttctgcaatctaaaaatagatggtgctttgcacagagagttagttaaaccgtatcaagaaaaatgggacaaattgcttttaacatcaacagaaaagtctcatgtacatttatttcctaaggacagtattatctatttaactgcagattctcccaat

SEQ ID NO: 11856 - DNA, 300 bp, Homo sapiens
gttcttcataataataggccacaaaagggctctgtggtttgcctccatgtgcactggcccctccccacccctagggggcactcagtagctgctgagaaggcctgtccacgaggctgttggaacccctccaataaatacttagaggtagtgtatctgatgcttgttttcatggagaaacttgtattggagaacttaaaacatcacgaatatttttaataggatccgcagacacccaaaggagaagcttggtcttttccaggtatttccaacttgagttcaacccaaagcctttgaaaggaa

SEQ ID NO: 11857 - DNA, 391 bp, Homo sapiens
tccgttgctgtcggattcaccccaccccattttcttgtgtctggaccatccgatgagacggatgctctgatgctctgaggcttctgggaggctgggccctggaggcaacgtgctgcaggcgcactctgtcagagtgaacagcaccgcgagacaggccaggctcgtggctcggaagacaaaccccacacacactcaaggggtcgagaacaaaccccacaccagggctctcaccttcttctcctaagtaggatttattttcagcacctgtttgatgcagtttttaatcctctacctattgcactggtgtgactcgttggccattatttgatttttgcacgaaaaaaagctttggtatagaaatcagcatactatttttttaaatctggagaga

SEQ ID NO: 11858 - DNA, 563 bp, Homo sapiens; identical to SEQ ID NO: 3302

SEQ ID NO: 11859 - DNA, 384 bp, Homo sapiens
  misc_feature 323, 331, 333, 339, 340, 341, 342, 347, 353, 354, 370, 373,375, 377, 378, 380: n = A,T,C or G
attataatagattataagctcacgcctataatcccagcactttgggaggcggaggcgggtggatcacctgaggtcaggagtttgagaccagcttgatcaacatggtcgaaaccctgtctctactaaaaataaaaattaattaccatgcaataagaatttgccaggcatggcggcgcatgcctgtaatccctgcaatgcctgtactcgggaggctgagacaggagaatcacttgaacccggtaggtggaggttacagtgaaccgaaactgagccactgcacgccagcctgggtgacagagaccagactccatctctctgaattncttaaaantnaaatgnnnntaacncccccnngggggccggggggggnggntnanncntata

SEQ ID NO: 11860 - DNA, 340 bp, Homo sapiens
ccacggcgattcttcccgcagagttgtgaagcgaaaggcttacaattaaaaggaagaaaaaaaaataaagataattcgggagtacaattgacaaagcgtgtgggtcgctcagcctccagcagtaactgctgatctccagttcttggagggttccggtgagaagaacgcccctactgcggtactgaggaagcggcaggaggagatgcggcccctggacatagacgaggtggaagcgcctgaggaagtggaggtgctggagcccgaggaggatttcgagcagttcctgctcccggtcatcaacgagatgcgcgaggacatcgcgtctcttatacgcgagcac

SEQ ID NO: 11861 - DNA, 400 bp, Homo sapiens
ctgaatgttctgtttattggggtgttgccatgggtaggaggctcagcagagccattctgcctcctgcttcccagtactaccccgtccagcaactgcctctcgtataaataagtatcaagatggtcagtagaaaaggagagcatctcctcagccctggaagacagtgtgggagcttcagcttaaggaagaggtaggtgcctgtccgccagcccagcctaaagggccaggaagacctggctatgggtgctggaggggccgttagccacaccccaaggttctacagtctttggtttggatcaggctgcatgccacggtcctggctggcagacccacccaccctgcgcctgtgacacacacccagcgcttttacctgcaggggcccggcattggatggggccct

SEQ ID NO: 11862 - DNA, 572 bp, Homo sapiens; identical to SEQ ID NO: 2538

SEQ ID NO: 11863 - DNA, 534 bp, Homo sapiens; identical to SEQ ID NO: 537

SEQ ID NO: 11864 - DNA, 593 bp, Homo sapiens
ggcacgagatttgaaaacaacttaaatttttagacaaatgattttagtatataaatttgcttttgtttttatacagaatataaagatttccctcattaatcttccatgtgaagggtattacaagcctggaggaagatactttctgcacacaagtatgtatcttatgtgtgcagtattggaaaccaatggtgtagtgctcctacacataaatggggtcaagtgacatcacaaattaaaagggggaaagagaaatattctagttaatcagatgcaagaagcaaacaagacgcaaaaactgtgcaaataagaccaagccagtaactttagttacgacactgcagattacactggaataacaggtttgtgaggctatagtgtgcaccacattaaaacagcaagaaagagctatttatatagaaaggctggaatgagggatttttactaaagcaaattaacttcttgtcaactgccaaaacaaaacaaaactgagcatatgagtgttagtatactgaaggcatgttataccagtttctgtgcagcatgctaaaagttagaactttttcactggtgcttatcaatcattaatagtcacg

SEQ ID NO: 11865 - DNA, 55 bp, Homo sapiens
atctttggggtctcctgaaaacttcccttaaaattagctctgagggaaaaatcaa

SEQ ID NO: 11866 - DNA, 555 bp, Homo sapiens
caaggaggtcctcccagccatccgaggctacgtgcactacttcttcggctgccgagactgcgctagccacttcgagcagatggctgctgcctccatgcaccgggtggggagtcccaacgccgctgtcctctggctctggtctagccacaacagggtcaatgctcgccttgcaggtgcccccagcgaggacccccagttccccaaggtgcagtggccaccccgtgaactttgttctgcctgccacaatgaacgcctggatgtgcccctgtgggacgtggaaaccaccctcaacttcctcaaggcccacttctccccaagcaacatcatcctggacttccctgcagctgggtcagctgcccggagggatgtgcataatgtggcagccgccccaaagctggcgatgggagccctggagctggaaagccggaattcaactctggaccctgggaagcctgagatgatgaagtcccccacacacaccaccccacatgtgccggctgagggacctgagcttatttgaagtcctgcctcattctcactggagcctcagtctct

SEQ ID NO: 11867 - DNA, 295 bp, Homo sapiens
ggccaagccgtgtggggtgcgcctgagcggggaagcccgcaaacaggtggaggtcttcagacagaatcttttccaggaggctgaggaattcctctacagattcttgccacagaaaatcatatacctgaatcagctcttgcaagaggactccctcaatgtggctgacttgacttccctccgggccccactggacatccccatcccagaccctccacccaaggatgatgagatggaaacagataagcaggagaagaaagaagtccctaagtgtggatttctccctgggaatgagaaa

SEQ ID NO: 11868 - DNA, 143 bp, Homo sapiens
ggcacgagactaagcaagcttttgtgtttattatcctcatttttactgaacattgttagttttggggtaatggaaacccactttttcattgtaatgactttgggggcttttgttagtaagggtgggtggggtgatgggttgca

SEQ ID NO: 11869 - DNA, 606 bp, Homo sapiens
aaaacctataagccaaggtgttccctgcctaaacttattgctgttcccacaaaggactaagcctgttcataagttaccaaagttgccattttggagatggaaattgacgaggagggaaggtcttttattggagagtatacagtacaagcagatcattctgccttagaggtgctaattcccgaaattagaagaccctttcttttccagtaacgaagttataaatatcagcttgttcatccaagccactggctgaggtgttaggaagaggaagagggtggtagaggaggtaagacagtagggaaagacaagggcccatgctcttagtggggaaaactcttggagccgtttactttgagctttgaacactgaaaccattgttggcagggttcagtcactgacagcacaagtttcactgaattgatccaagagtttagtgatttcaaaagccttggtctcaggagaagattaaactttcatattgggcagtggttcactttaaaacacacacatacacacacaaaacaattttttaagaaatcctaataagtaacatacccaaaatgctctgtcttgagtcatgagaaccatcagttcttgatattgtct

SEQ ID NO: 11870 - DNA, 556 bp, Homo sapiens
gggccctcaagtctccgtctggagtaaggtgctgcggagcgacgcggcctgggaggataaggatgaatttttagatgtgatctactggttccgacagatcattgctgtggtcctgggtgtcatttggggagttttgccattacgagggttcttgggaatagcaggattctgcctgatcaatgcaggagtcctgtacctctacttcagcaattacctacagattgatgaggaagaatatggtggcacgtgggagctcacgaaggaagggtttatgacctcttttgccttgttcatggtcatttggatcatcttttacactgccatccattatgactgatggtgtacagctcccaagtgctccctatccagtccaaaggaccctcttgattacagcacaggaacttgatcgttggggaaccccagccccttggaacttggaagacccgtgtttcctggaccgcgaatcagtgtgttgggcatcagtgttttctgcaacggttgtgacctgaaactttttaaaaaccacccacctttggggaagcatttctgaatttat

SEQ ID NO: 11871 - DNA, 500 bp, Homo sapiens
cggtgctgctgctgaacccagctctgggggaccggctggtggcgggcagcacagatcagctgttgagcgccttcgtcccgcctgaggagccccccttgcagccggcccgctggctggaggcctcagaggaggagcgccaagtgggcctgcggctgcgcatctgccacgggaagccagtgacgcaggtgacctggcacgggcgtggggactacctggccgtggtgctggccacccaaggccacacccaggtgctgattcaccagctgagccgtcgccgcagccagagtccgttccgccgcagccacggacaggtgcagcgagtggccttccaccctgcccggcccttcctgttggtggcgtcccagcgcagcgtccgcctctaccacctgctgcgccaggagctcaccaagaagctgatgcccaactgcaagtgggtgtccagcctggcggtgcaccctgcaggtgacaacgtcatctgtgggagctacgatagcaagctg

SEQ ID NO: 11872 - DNA, 505 bp, Homo sapiens; identical to SEQ ID NO: 539

SEQ ID NO: 11873 - DNA, 300 bp, Homo sapiens
ctcttctcctcgttcctctgaaccctccaccaatgtgcctcagcctgtgtgctgtgtggcaacagcattctggttcccactgccaagatctcccaccactctgctgggatctgcagtggcagggagtgggggttgtgtaaaggggaagtcatcttttgagatccagatagacatggtttgtgcacttacgtccagatgggaagcatccttcctgcaaccctaaaataatcatgcagcctctcagacggacgccatcggtcccaaggccttaggtggaggaagcaaagcaggccaggcctg

SEQ ID NO: 11874 - DNA, 750 bp, Homo sapiens
  misc_feature 377, 586, 595, 619, 687, 699, 708, 716, 720, 731, 739, 749: n = A,T,C or G
cgcgaaggctaaagctgactgtgacatcagcaggttgaaggagcagctcaaggctgcaacggaagcactgggggagaagtcccctgacagtgccacggtgtccggatatgatataatgaaatctaaaagcaaccctgacttcttgaagaaagacagatcctgtgtcacccggcaactcagaaacatcaggtccaagagtctgaaggaaggcctgacggtgcaagaacggttgaagctctttgaatccagggacttgaagaaagactaggtgtgtcccatccaagttgagcacgcgccttccccagcttgcagcagcacaccccaagcgctgcttttcacctgtacctttgttttattattattattattattgctgntgttgtcatcgttaactgtgggcatggaatgcgtgaggctggcttctgggttgtccacaccactctctgctgtgttgacttcctgttgtcttcatcaaagcttttttccgtggtattctaaaattaggccagcagtgggggctgggagggcatctgtgttaatactttccttggcttgtgacccccacactcacttgtcagtattaaangcccaacanccttgttgataagctccctgtctnaccatgttctggtgtggaaacgggcccacccagcacgccttaaggtagattggaatcccactggtcanagaaaaactatncggacactncacttggnctgngttacacactnacttctanccgctagttng

SEQ ID NO: 11875 - DNA, 366 bp, Homo sapiens
  misc_feature 163: n = A,T,C or G
tgtttcggtcttgttgcccaggctggagtgcaatggcacgatctcggctcaccgtaacctccgcctcctgggttcaagcaattctccctgcctcagcctcccaagtagctgggattacaggcacctaccaccatgcccggctaatttttgtattttttagtanagacagggttttgtcatgttggtcaggttggcctctaactcctggcctcaggtgatacgcctatctcgacctcccaaagcactgggattacaggcatgagccaccacatccggccagcattttaacagataatagagcacattctccattgaactcttccaaaagaatgttacctggactcctgcaaaccagtgactgaaatg

SEQ ID NO: 11876 - DNA, 491 bp, Homo sapiens; identical to SEQ ID NO: 543

SEQ ID NO: 11877 - DNA, 425 bp, Homo sapiens
ggcttagcggataacaatttcacacaggatggattggtcatgaactcggtttaagacagggcttcttcaccattgcgagagcgttcaccgggacgagtggcaagagtcttggcttggatagcatgaagagccccagtacaaggaagaatactggaaatgctcaattcgtggagcgcgtttaaacgacgatttatttggttttcaatgaccgaggacttatgacaggatgattacatttgaccttgggacatgaacgcttggactgctgacttgtgtgtaaagctgttttgtttgtttgtgtcttgcttgacagagggtctcgatcatggtgatacctgatgctttggacatgtccacttactcctctattattcgttggatcattgtttattctgatagatagtgacttatgttcggatgtcgat

SEQ ID NO: 11878 - DNA, 826 bp, Homo sapiens
tttaggcttctgcaggggactctgtacatgtgcgttggcattatggatcgatttttacaggttcagccagtttcccggaagaagcttcaattagttgggattactgctctgctcttggcctccaagtatgaggagatgttttctccaaatattgaagactttgtttacatcacagacaatgcttataccagttcccaaatccgagaaatggaaactctaattttgaaagaatcgaaatttgagttgggtcgacccttgccactacacttcttaaggcgagcatcaaaagccggggaggttgatgttgaacagcacactttagccaagtatttgatggagctgactctcatcgactatgatatggtgcattatcatccttctaaggtagcagcagctgcttcctgcttgtctcagaaggttctaggacaaggaaaatggaacttaaagcagcagtattacacaggatacacagagaatgaagtattggaagtcatgcagcacatggccaagaatgtggtgaaagtaaatgaaaacttaactaaattcatcgccatcaagaataagtatgcaagcagcaaactcctgaagatcagcatgatccctcagctgaactcaaaagccgtcaaagaccttgcctctccactgataggaaggtcctaggctgccgtggcccctggggatgtgtgcttcattgtgccctttttcttattggtttagaactcttgattttgtacatagtcctctggtctatctcatgaaacctcttctcagaccagttttctaaacatatattgaggaaaaataaagcgattggtttttcttaagg

SEQ ID NO: 11879 - DNA, 261 bp, Homo sapiens
ggcttagcggataacaatttcacacaggagaccattgcactggagagaaaacccataaatgccccgaatgtgggagagcctttttttatcagtcattccttatgagacatatgaaaattcacactggagagaaaccgtatgaatgtgggaaatgtgggaaagcctttagatattccttacaccttaataaacatttaagaaagcatgttgtgcagaagaagccctaccaatgtgaagaatgtgggaaagtcattccggagt

SEQ ID NO: 11880 - DNA, 539 bp, Homo sapiens
  misc_feature 235: n = A,T,C or G
tgagatgatatcatttacgggggaaggcgctttgtgaagtagccttatttctcttgtcctttcgtacagggaggaatttgaagtagatagaaaccgacctggattactccggtctgaactcagatcacgtaggactttaatcgttgaacaaacgaacctttaatagcggctgcaccatcgggatgtcctgatccaacatcgaagtcgtaaaccctattgttgatatggactctanaataagattgcgctgttatccctaaggtaacttgttccgttggtcaagttattggatcaattgagtatagtagttcgctttgactggtgaagtcttagcatgtactgctcggaagttgggttctgctccgaagtcccccaaccgaaatttttaatgcaggtttggtagtttaagaactgtgggtttgttagtactgtttgcattaataaattaaagctccataaggtctctcgtcttgctgtgtcatgcccccctcttcaccgggcaggtcaattcactgggtttaaaattagaaaaaactgaa

SEQ ID NO: 11881 - DNA, 163 bp, Homo sapiens; identical to SEQ ID NO: 2683

SEQ ID NO: 11882 - DNA, 613 bp, Homo sapiens
  misc_feature 613: n = A,T,C or G
aaccctgttcttgggtgggtgtgggtataatgctaagttgagatgatatcatttacgggggaaggcgctttgtgaagtaggccttatttctcttgtcctttcgtacagggaggaatttgaagtagatagaaaccgacctggattactccggtctgaactcagatcacgtaggactttaatcgttgaacaaacgaacctttaatagcggctgcaccattgggatgtcctgatccaacatcgaggtcgtaaaccctattgttgatatggactctagaatgggattgcgctgttatccctagggtaacttgttccgttggtcaagttattggatcaattgagtatagtagttcgctttgactggtgaagtcttagcatgtactgctcggaggttgggttctgctccgaggtcgccccaaccgaaatttttaatgcaggtttggtagtttaggacctgtgggtttgttaggtactgtttgcattaataaattaaagctccatagggtcttctcgtcttgctgtgttatgcccgcctcttcacgggcaggtcaatttcactggttaaaagtaagagacagctgaaccctcgtggagccattcatacaggtccctattn

SEQ ID NO: 11883 - DNA, 103 bp, Homo sapiens
ggcttagcggataacaatttcacacaggacgactccaagcaagtagctttccacatttgtcacagaaatcagaggagagatggtgttgggagccctttggaga

SEQ ID NO: 11884 - DNA, 627 bp, Homo sapiens
aatatggaagggtgattcgtcaacccgtgggcaggattttctttgcgggcacagagactgccacaaagtggagcggctacatggaaggggcagttgaggctggagaacgagcagctagggaggtcttaaatggtctcgggaaggtgaccgagaaagacatctgggtacaagaacctgaatcaaaggacgttccagcggtagaaatcacccacaccttctgggaaaggaacctgccctctgtttctggcctgctgaagatcattggattttccacatcagtaactgccctggggtttgtgctgtacaaatacaagctcctgccacggtcttgaagttctgttcttatgctctctgctcactggttttcaataccaccaagaggaaaatattgacaagtttaaaggctgtgtcattgggccatgtttaagtgtactggatttaactacctttggcttaattccaatcattgttaaagtaaaaacaattcaaagaatcacctaattaatttcagtaagatcaagctccatcttatttgtcagtgtagatcaactcatgttaattgatagaataaagccttgtgatcactttctgaaattcacaaagttaaacgtgatgtgctcatcagaa

SEQ ID NO: 11885 - DNA, 570 bp, Homo sapiens
ttccgttgctgtcgtagacgtgttgggatgttggctgtactcttgaaggtggttcgcacggagagtcttttgggcctttgaaaagggatgtccccttccattgtgagatgtgtccctggcgttggaatctactttggcactctctactctttgaagcagtatttcttgcgaggccatcccccaaccgccctggagtcagtcatgctgggggtgggctctcgctctgttgcaggggtctgtatgtcacctatcactgtaatcaagacgcgctatgagagtgggaaatatggctatgagagtatctacgctgccctgaggagcatctatcacagtgaggggcaccggggcctcttcagtggcctgacagcaactctccttcgagatgcgcccttctcaggaatctacctgatgttttacaaccagaccaaaaatatagtgcctcatgaccaggtggatgcaacccttattcctattacaaatttcagctgtgggatatttgctggtattctggcctcactggtaactcaacctgcggatgttatcaaaactcatatgcagctttatccactg

SEQ ID NO: 11886 - DNA, 300 bp, Homo sapiens; identical to SEQ ID NO: 3317

SEQ ID NO: 11887 - DNA, 539 bp, Homo sapiens
ccgttgctgtcgatccgggaccggcggttgtctgtggccggaggctgatcagtgggctagaacagatcagacattttgtaatgatgcctgaaataaacactaaccacctcgacaagcaacaggttcaactcctggcagagatgtgtatccttattgatgaaaatgacaataaaattggagctgagaccaagaagaattgtcacctgaacgagaacattgagaaaggattattgcatcgagcttttagtgtcttcttattcaacaccgaaaataagcttctgctacagcaaagatcagatgctaagattacctttccaggttgttttacgaatacgtgttgtagtcatccattaagcaatccagccgagcttgaggaaagtgacgcccttggagtgaggcgagcagcacagagacggctgaaagctgagctaggaattcccttggaagaggttcctccagaagaaattaattatttaacacgaattcactacaaagctcagtctgatggtatctggggtgaacatgaaattgattacatt

SEQ ID NO: 11888 - DNA, 386 bp, Homo sapiens
caagatctgtgcgaggaggccctgcggcactatgaggacttccccaagctgtggatgatgaaggggcagatcgaggagcagaaggagatgatggagaaggcgcgggaagcctataaccaggggttgaagaagtgtccccactccacacccctgtggcttttgctctctcggctggaggagaagattgggcagcttactcgagcacgggccattttggaaaagtctcgtctgaagaacccaaagaaccctgggctgtggttggagtccgtgcggctggagtaccgtgcggggctgaagaacatcgcaaatacactcatggccaaggcgctgcaggagtgccccaactccggtatcctgtggtctgaggccatcttcctcgaggcaag

SEQ ID NO: 11889 - DNA, 427 bp, Homo sapiens
gcatgcaccaccatgtccagctaatttttgtattttttagtagagacggggtttcactatatgttggccaggctggtctcaaacttctgacctcaagtgatccactcaccttggcctcccaaagtgctgggattacagacgtgagccaccatgcccggccaggattttccactcttgaagggagtattttgttgtcacttcaactcgctgttttttttccagacaacctcaaatatgaccacactacagcctgtacacaacaagacagtttatcttgtccatggggtaagtgtatgcctgatctttttaattcagtacaatctctgaaggtgttaacactaatgttttacaagaatgtagaggcgactcggtgctatgaagcgtgttaaacaactcacacaattgctacaaaacaccagggaggggc

SEQ ID NO: 11890 - DNA, 430 bp, Homo sapiens
gtggcctgaattggaccgaaggcctgagttggatggaagtctcaaggcttgagttagaagtcttaagacctgggacaggacacatggaaggcctaagaactgagacttgtgacacaaggccaacgacctaagattagcccagggttgtagctggaagacctacaacccaaggatggaaggcccctgtcacaaagcctacctagatggatagaggacccaagcgaaaaaggtatctcaagactaacggccggaatctggaggcccatgacccagaacccaggaaggatagaagcttgaagacctggggaaatcccaagatgagaaccctaaaccctacctcttttctattgtttacacttcttactcttagatatttccagttctcctgtttatctttaagcctgattcttttgagatgtactttttgatg

SEQ ID NO: 11891 - DNA, 562 bp, Homo sapiens; identical to SEQ ID NO: 3336

SEQ ID NO: 11892 - DNA, 507 bp, Homo sapiens; identical to SEQ ID NO: 3339
  misc_feature 352: n = A,T,C or G

SEQ ID NO: 11893 - DNA, 388 bp, Homo sapiens
atgtctcatctgtgctctccgtgttcctttcctttttttgatatatgaaaacctattctggtctaaattgtgttactagcctcaaaatacatcaaaaaataagttaatcaggaactgtacggaatatatttttaaaaatttttgtttggttatatcaaaatagttacaggcactaaagttagtaaagaaaagtttaccatctgaaaaagctggattttctttaagaggttgattataaagttttctaaatttatcagtacctaagtaagatgtagcgctttgaatatgaaatcataggtgaagacatgggtgaacttacttgcataccaagttgatacttgaataaccatctgaaagtggtacttgatcatttttaccattattttta

SEQ ID NO: 11894 - DNA, 408 bp, Homo sapiens
tcccgtctcagcctcccagtagctggaattacaggcatgcgccaccacgcccggcttatttcgtatttttagtagagacgggtttccgcatgttggtcaggctggtctggaactcctgacctcaagtgatccacctggctcagcttaccgaagtgctgagattccgggtgtgagccaccgcgcctagccctctaaacttttaaataatcgtgaaatgtatgcgcagctgaagcgaattcagctatttcctctaccttttgtgtggaatttaaaatactgaacttgtgagatgaacctggtgggcaccagttctcaaacttcttggtcacaggacgcttgcactctcttaaaatgtactgaggacacctaaaagcttttgctcactgttgtttactactgctatttact

SEQ ID NO: 11895 - DNA, 276 bp, Homo sapiens
ataaaatcctttcttcccatatgcttgtgacggattccccctccccagaatacttaaaatctgacagcgatttagagttttattgccatcttctcagaggcagcttgaacccaaaggaatttccaacttatgaatacataaaatttgtaggaaattttcgctcttacaacaatgtgcctagcccctcctgtaatggttttgacaacaccctttcaagaccttgccgggtgccactaggaaaggaggtttgcttcattgccaccgttcgtctggcaa

SEQ ID NO: 11896 - DNA, 561 bp, Homo sapiens; identical to SEQ ID NO: 576

SEQ ID NO: 11897 - DNA, 277 bp, Homo sapiens
gcgaactcatctttgccagtacaggagctcgtgccgtggcccacagcccacagcccacagccatgggctgggacctgacggtgaagatgctggcgggcaacgaattccaggtgtccctgagcagctccatgtcggtgtcagagctgaaggcgcagatcacccagaagatcggcgtgcacgccttccagcagcgtctggctgtccacccgagcggtgtggcgtgcaggacagggtcccccttgccagccagggcctgggccccggcagcacggtcctg

SEQ ID NO: 11898 - DNA, 269 bp, Homo sapiens
aggttgcgtcctttctcaaaaggaataagcatgggcctttcctcctctttgtttcctttctacacgttcacatccctcttatcactatggagaacttcctcgggaagagtctccacgggctgtatggggacaacgtagaggagatggactggatggtaggacggatccttgacactttggacgtggagggtttgagcaacagcaccctcatttattttacgtcggatcacggcggttccctagagaatcaacttggaaacaccagtatg

SEQ ID NO: 11899 - DNA, 358 bp, Homo sapiens
taagctcgggaattcggctcgaggctctggctcttccagcaaaccagcaggagctgactctacacacaaagtcccagtggtcatgctggagccaattcgaataaaacaagaaaacagtggaccaccggaaaattatgatttccctgttgttatagtgaagcaagaatcagatgaagaatctaggcctcaaaatgccaattatccaagaagcatactcacctccctgctcttaaatagcagtcagagctctacttctgaggagactgtgctaagatcagatgcccctgatagtacaggagatcaacctggacttcaccaggacaattcctcaaatggaaagtctgaatggttggatcct

SEQ ID NO: 11900 - DNA, 528 bp, Homo sapiens; identical to SEQ ID NO: 3360

SEQ ID NO: 11901 - DNA, 157 bp, Homo sapiens
tcactatatatatgaggaacctgaggtccaaagtggggaagtgtcttacccaaggtcacatggtttcatagaaattatgttgaatccaataagccttcccggacattccaagcctcttaaccatggcatctatgttgaggatgtcaatgtttatttc

SEQ ID NO: 11902 - DNA, 448 bp, Homo sapiens
gaaattaatttaaggtcttttcttaaaaaaaaaatccacctcattttcagttaacatgtgccattaaatagataacatcctgtggatttagggatattttccagccagaatggatccaaaaaaattgaatggtgcttaaattgagaaataataataaatatatctatatagaatagacatatcccactgtatattaattgaggttacagaaagttctttatataaaacttatttaaatttttcatatttcatctttgaaaaagtctgaaaaaaatccataatattttctggtatgaaagtttgacagtattaatattttttttatattttcttaaatcattaaaccattttaatatatgttaactactaataaatggtttattctttctaactccatataagcttttccagcaaagattgtaataacacatttatgttctcgtttttc

SEQ ID NO: 11903 - DNA, 485 bp, Homo sapiens; identical to SEQ ID NO: 3361
  misc_feature 84: n = A,T,C or G

SEQ ID NO: 11904 - DNA, 591 bp, Homo sapiens
  misc_feature 52: n = A,T,C or G
cgaattcgcactcttttttagttatccccacctgcccacttcccttattagnggcgaaatattttaaccaaattatctgcttccctgactattcctggagtacagctacatctcattgctgcccttcttcccaatccaaagcctcctttgtgtcctctaacatccccacaatatcaccccttaccacaagacctcccttcagcttaatctctcccactctaggttcccacgccgcccctaatcccacttgaagcagccctgagaaacatcgcccattctctctccataccaccccccaaaaattttcgccgctccaacacttcaacactattttgttttatttgtcttattaatatcagaaggcaggaatgtcaggcctctgagcccaggccaggccatcgcatcccctgtgacttgcacatatacatccagatggcctgaagtaactgaagatccacaaaagaagtaaaaacagccttaactgatgacattccaccattgtgatttgttcctgccccaccctaactgatcaatgtactttgtaatctcccccacccttaagaaggttctttgtaattctccccacccttg

SEQ ID NO: 11905 - DNA, 637 bp, Homo sapiens
tgaattcgaacccactatgatccccctcgaaagctcatggctatgcagcggccaggtccctatgataggccgggggctggcagagggtataatagcattggcagaggagctgggtttgaaaggatgaggcgtggtgcctatggtggagggtatggaggctatgatgactatggtggctataatgatggatatggctttgggtctgatagatttggaagagacctcaattactgtttttcaggaatgtctgatcatagatacggagatggtgggtccagtttccagagcaccacagggcactgtgtacacatgagggggttaccttacagagccactgagaatgatatttataatttcttctcacctcttaatcccatgagagtacatattgaaattggacccgatggcagagttaccggtgaggcagatgttgaatttgctactcatgaagatgctgtggcagctatggcaaaagacaaagctaatatgcaacacagatatgtggagctcttcttaaattctactgcaggaacaagtgggggtgcttacgatcacagctatgtagaactttttttgaattctacagcaggggcaagtggtggcgcttatggtagccaaatgatgggagggatgggct

SEQ ID NO: 11906 - DNA, 486 bp, Homo sapiens
tcgagctcttggcactgggggcgtcaggctgtcggatgttccttccttccataccccagcataccttctccttgcttagagtgcaggggtctgagacagcagccactggggttgaggagggggaggagacccctgagacccagaggtgccccttcctcagctgggagtgggccgcctcatgctctgctggggcctggcatggaacgtgagacctgtaagctgtcccgcgggccccggcaccccgcccagctgtgcactttgctcactcgctctgccatggtgccatgactgtactgtgcccatgcgtgacctggactgtggaccctctgctgctccgcctctcccctccccactggctctgtctgctctcctgccaccctgctggccgggagcccctccccggggagttcttggtgaagtccttcccgggcctccttgtgtttttgcctcattcctactgtcacacaggtcacgagggtggactcc

SEQ ID NO: 11907 - DNA, 554 bp, Homo sapiens
agctcggaattcggctcgagcctgcaccccgacctctggcagatcttcgacaaccccgtcgactggaaggagcagtacatccacgagaactacagccgggccctggaaggggaaggaatcgtggagcagccatgcccggacgtgtactggttcccactgctgtcagaacaaatgtgtgatgagctggtggcagagatggagcactacggccagtggtcaggcggccggcatgaggattcaaggctggctggaggctacgagaatgtgcccaccgtggacatccacatgaagcaggtggggtacgaggaccagtggctgcagctgctgcggacgtatgtgggccccatgaccgagagcctgtttcccggttaccacaccaaggcgcgggcggtgatgaactttgtggttcgctaccggccagacgagcagccgtctctgcggccacaccacgactcatccaccttcaccctcaacgttgccctcaaccacaagggcctggactatgagggaggtggctgccgcttcctgcgctacgactgtgtgatctcctcccc

SEQ ID NO: 11908 - DNA, 645 bp, Homo sapiens
aagctcggaattcggctcgaggaccttgggaacccttggtgtctggaacaaattattccctgggcctccgatttgcagttccacgtcttgagaaaacaaacatgagcattaacttcgatctccaaatcagaagttccaacaaggacaatccagacagcaattttgtgagcctgcaaatcaacatcactgctgtagcgcaggtggaaataagaggagtgtcacaccctccgcagattgttctgcccattcataactgggaaccagaagaggagccccacaaagaggaggaggttggaccattggtggaacatatttatgagctgcacaatattggaccaagtaccatcagtgacaccatcctggaggtgggctggcctttctctgcccgggatgaatttcttctctatattttccatattcaaactctgggacctctgcagtgccaaccaaatcctaatatcaatccacaggatataaagcctgctgcctccccagaggacacccctgagctcagcgcctttttgcgaaactctactattcctcatcttgtcaggaagagggatgtacatgtggtcgaattccacagacagagccctgcaaaaatactgaattgtacaaatatcgagtgtttacaaatctctgtgc

SEQ ID NO: 11909 - DNA, 194 bp, Homo sapiens; identical to SEQ ID NO: 593

SEQ ID NO: 11910 - DNA, 514 bp, Homo sapiens
ttcaaacagcagccctcagagcagttggcaacatagtgactggcaccgacgagcagacccaggttgttctcaattgtgatgtcctgtcacacttcccaaatctcttatcacacccaaaagagaagataaataaggaagcagtgtggttcctttccaacataacagcaggcaaccagcaacaagttcaagctgtaatagatgctggattaattcctatgataattcatcagcttgctaagggggactttggaacacaaaaagaagctgcttgggcaatcagcaacttaacaataagtggcagaaaagatcaggttgagtaccttgtacagcagaatgtaataccaccgttctgtaatttactgtcagtgaaagattctcaagtggttcaggtggttctagatggtctaaaaaacattctgataatggccggtgatgaagcaagcacaatagctgaaataatagaggaatgtggaggtttggagaaaattgaagttttacagcaacatgaaaatga

SEQ ID NO: 11911 - DNA, 559 bp, Homo sapiens; identical to SEQ ID NO: 3377

SEQ ID NO: 11912 - DNA, 602 bp, Homo sapiens
cagggtggcgactctatagactctaggacataaattagaggtctccaaaatcggatctggggctctgggatagctgacccagccccttgagaaaccttattgtacctctcttatagaatatttattacctctgatacctcaacccccatttctatttatttactgagcttctctgtgaacgatttagaaagaagcccaatattataatttttttcaatatttattattttcacctgtttttaagctgtttccatagggtgacacactatggtatttgagtgttttaagataaattataagttacataagggaggaaaaaaaatgttctttggggagccaacagaagcttccattccaagcctgaccacgctttctagctgttgagctgttttccctgacctccctctaatttatcttgtctctgggcttggggcttcctaactgctacaaatactcttaggaagagaaaccagggagcccctttgatgattaattcaccttccagtgtctcggagggattcccctaacctcattccccaaccacttcattcttgaaagctgtggccagcttgttatttataacaacctaaatttggttctag

SEQ ID NO: 11913 - DNA, 477 bp, Homo sapiens
tgatgatgacttcttaggggaatgtgaatgtacccttggacaaattgtttccagcaagaagctaactcgaccactggtgatgaaaactggcagacctgcaggaaaagggagcattacgatttcagctgaagaaataaaagataatagagtggtcttgtttgaaatggaagccagaaaactggataataaggatctatttggaaagtcagacccatacctggaattccacaagcagacatctgatggaaactggctaatggttcatcggacagaggttgttaaaaacaacttgaatcctgtttggaggcctttcaagatctctcttaactcactgtgttacggagatatggacaaaaccattaaggtggagtgttatgattatgacaatgatgggtcacatgatctcattggaacatttcagaccaccatgacaaaactgaaagaagcctccagaagctcacctgttgaatttgaatg

SEQ ID NO: 11914 - DNA, 1599 bp, Homo sapiens
aattccggcggaagtggtggaggaacttccggcagcggcagctcaagtggccaaggcaagatgggtcaaagtcagagtggtggtcatggtcctggaggtggcaagaaggatgacgaggacaagaaaaagaaatatgaacctcctgtaccaactagagtggggaaaaagaagaagaaaacaaagggaccagatgctgccagcaaactgccactggtgacacctcacactcagtgccggttaaaattactgaagttagagagaattaaagactatcttctcatggaggaagaattcattagaaatcaggaacaaatgaaaccattagaagaaaagcaagaggaggaaagatcaaaagtggatgatctgagggggaccccgatgtcagtaggaaccttggaagagattattgatgacaatcatgccatcgtgtctacatctgtgggctcagaacactacgtcagcattctttcatttgtagacaaggatctgctggaacctggctgctcggtcctgctcaaccacaaggtgcatgccgtgataggggtgctgatggatgacacggatcccctggtcacagtgatgaaggtagaaaaggccccccaggagacctatgcagatattggggggttggacaaccaaattcaggaaattaaggaatctgtggagcttcctctcacccatcctgaatattatgaagagatgggtataaagcctcctaagggggtcattctctatggtccacctggcacaggtaaaaccttgttagccaaagcagtagcaaaccaaacctcagccactttcttgagagtggttggctctgaacttattcagaagtacctaggtgatgggcccaaactcgtacgggaattgttccgagttgctgaagaacatgcaccgtccatcgtgtttattgatgaaattgacgccattgggacaaaaagatatgactccaattctggtggtgagagagaaattcagcgaacaatgttggaactgctgaaccagttggatggatttgattctaggggagatgtgaaagttatcatggccacaaaccgaatagaaactttggatccagcacttatcagaccaggccgcattgacaggaagattgagttccccctgcctgatgaaaagacgaagaagcgcatctttcagattcacacaagcaggatgacgctggctgatgatgtaaccctggacgacctgatcatggctaaagatgacctctctggtgctgacatcaaggcaatctgtacagaagctggtctgatggccttaagagaacgtagaatgaaagtaacaaatgaagacttcaaaaaatctaaagaaaatgttctttataagaaacaggaaggcacccctgaggggctgtatctctaatgaaccatggctgtcatcaggaaaatggttgggagatttctcaatccctgaaagggatgaggttgggggagttgcccagaggaatccctgttcccactgatttttattagcaaaacatcctgtgtcttttggagtacgatgtgtaagtgcccattgggtggcctgttggtcactgtgcagcagtctgcttcccaataaagcgtgctctttcacaag

SEQ ID NO: 11915 - DNA, 92 bp, Homo sapiens
catggcacagccaggactgccaccagtaccaggagcaccaggaatgcctccaggcatacctccattaatgccaggtgttcctcctctgatgc

SEQ ID NO: 11916 - DNA, 502 bp, Homo sapiens
tggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaaggg

SEQ ID NO: 11917 - DNA, 259 bp, Homo sapiens
gtcccggacaggcgtggaggtggggcgcaggcgaggatgaagcttgagttggccaggagtcggaaaacgattgcaggcgggaccgcgtccgtcggggctgaggaaacttagcgtggcagaccctaaactgggataactttagggatatggccttcttttcccagttgcctcaaacttagagcagcgtcgtctttagccgaagattcattttcccagcattttccttctccaggcggagtagttggagacagagggcaag

SEQ ID NO: 11918 - DNA, 254 bp, Homo sapiens; identical to SEQ ID NO: 3399

SEQ ID NO: 11919 - DNA, 468 bp, Homo sapiens; identical to SEQ ID NO: 623

SEQ ID NO: 11920 - DNA, 481 bp, Homo sapiens
ttaacaccttaagagttgtagttactgaccagaaatatggacagacttcttagacttggaggaggtatgcctggactgggccaggggccacctacagatgctcctgcagtggacacagcagaacaagtctatatctcttccctggcactgttaaaaatgttaaaacatggccgtgctggagttccaatggaagttatgggtttgatgcttggagaatttgttgatgattataccgtcagagtgattgatgtgtttgctatgccacagtcaggaacaggtgtcagtgtggaggcagttgatccagtgttccaagctaaaatgttggatatgttgaagcagacaggaaggccggagatggttgttggttggtatcacagtcaccctggctttggttgttggctttctggtgtggatatcaacactcagcagagctttgaagccttgtcggagagagctgtggcagtggttgtggatcccattc

SEQ ID NO: 11921 - DNA, 435 bp, Homo sapiens; identical to SEQ ID NO: 3403

SEQ ID NO: 11922 - DNA, 543 bp, Homo sapiens; identical to SEQ ID NO: 627

SEQ ID NO: 11923 - DNA, 587 bp, Homo sapiens
taagctcggaattcgaattccgtggttttgtctgctgcgcccgctcttcgcgctctcgtttcattttctgcagcgcgccagcaggatggcccacaagcagatctactactcggacaagtacttcgacgaacactacgagtaccggcatgttatgttacccagagaactttccaaacaagtacctaaaactcatctgatgtctgaagaggagtggaggagacttggtgtccaacagagtctaggctgggttcattacatgattcatgagccagaaccacatattcttctctttagacgacctcttccaaaagatcaacaaaaatgaagtttatctggggatcgtcaaatctttttcaaatttaatgtatatgtgtatataaggtagtattcagtgaatacttgagaaatgtacaaatctttcatccatacctgtgcatgagctgtattcttcacagcaacagagctcagttaaatgcaactgcaagtaggttactgtaagatgtttaagataaaagttcttccagtcagtttttctcttaagtgcctgtttgagtttactgaaacagtttacttttgttcaataaagt

SEQ ID NO: 11924 - DNA, 532 bp, Homo sapiens
gtctacagaaacatgctttgcacttctgggaggacatccttgttttcttaccacacaagatattcatttgggtgtgaatgaaagtctcacggacacggcccgtgtattgtctagcatggcagatgcagtattggctcgagtgtataaacaatcagatttggacaccctggctaaagaagcatccatcccaattatcaatgggctgtcagatttgtaccatcctatccagatcctggctgattacctcacgctccaggaacactatagctctctgaaaggtcttaccctcagctggatcggggatgggaacaatatcctgcactccatcatgatgagcgcagcgaaattcggaatgcaccttcaggcaactactccaaagggttatgagccggatgctagtgtaaccaagttggcagagcagtatgccaaagagaatggtaccaagctgttgctgacaaatgatccattggaagcagcgcatggaggcaatgtattaattacagacacttggataagcatgggacaagaagag

SEQ ID NO: 11925 - DNA, 391 bp, Homo sapiens
acagcgggcatatactgtgtaggagacgaggtgaccatggctgatctgtgcttggtgcctcaggtggcaaatgctgaaagattcaaggtggatctcaccccctaccctaccatcagctccatcaacaagaggctgctggtcttggaggccttccaggtgtctcacccctgccggcagccagatacacccactgagctgagggcctagctcccaaatcctgccccgttggcacagggccacaggagcagaagctgggtgggctgaagaggcctggaaacgagagtcttaattgaggagatgggagactcgaactctagccctggatctgccttcctgctgaaacttgttccacctcagtcccctcatctgtcacacgcatgtggggtggagt

SEQ ID NO: 11926 - DNA, 416 bp, Homo sapiens
tgaaacctcgtgcctggctcgtctgccacctacatttctctttccagctgctgttttgtaaaaagaaaaagaaaaaagaagcccaaactagtgagagtaatatctaattatctcattttttgtaggtctgtgataaagaacttagtcatcccttccacctcctactgtgaagaacagaccctgggtcccacactgaaatcccctctagtcacccattcccaccccccagggagctgcctcccaggcagggggtgcagaaaatgattgatgggctggggaaccctggagagcctcgactccggaagtctcaaggtgcctcctcctctccttagctggcccgttggttttctgagcagggggctgaactgtgaacaagtcagacaaataaagcaagggtctgcaccatctgcaatgtc

SEQ ID NO: 11927 - DNA, 496 bp, Homo sapiens
ggataccccttccgtgcctgggcttcacccctgaacatcagcgagacttcattgcccgtgacctaggtcctaccctcgccaacagtactcaccacaatgtccgcctactcatgctggatgaccaacgcttgctgctgccccactgggcaaaggtggtactgacagacccagaagcagctaaatatgttcatggcattgctgtacattggtacctggactttctggctccagccaaagccaccctaggggagacacaccgcctgttccccaacaccatgctctttgcctcagaggcctgtgtgggctccaagttctgggagcagagtgtgcggctaggctcctgggatcgagggatgcagtacagccacagcatcatcacgaacctcctgtaccatgtggtcggctggaccgactggaaccttgccctgaaccccgaaggaggacccaattgggtgcgtaactttgtcgacagtcccatcattgtagacatcaccaa

SEQ ID NO: 11928 - DNA, 302 bp, Homo sapiens
tctaacatgacagaaagtctttgaaaatgattcttaaatgctccttaaaagacacatctgacatttttaacaacttactaaaagttgaaatgaccattctgtgtagccataaaagaaacacactgaagtgtatggcctctggagttagtcttaggaaaacttattgctctgtgtcaatgttaacctgtctcagatcaagtaattctttcactaggttgggtttggggaggggggaaaagaggggctcttcctaggagaacgataagaaatggaaagactccttgaagtgttgcaagggaacc

SEQ ID NO: 11929 - DNA, 251 bp, Homo sapiens
tttggccaacgtgacagggctttgtttggtggtaaaaagggttactagacacccctcattccactgccactggagggcgcatttctcagctcttgctcttcaaacctgctgaaaggaattcctagatctaaacaccagtttccttcatgtccttatcgcttcctgtccaaatctactgaaaaccccttcggctgttacttctggatgtgatgtcgcagtctttagcccatcctgtctgctagtgccatctg

SEQ ID NO: 11930 - DNA, 209 bp, Homo sapiens
agagcttatatgtaattgcctgctgtcagtgaatcttgggtttaaggcccattagaaaaatagcaggctttagtagagtggttttttccagtgagtacttttcagtcaacaggtttattgggaggtggctaaaatgcacatggaggtgagcccttccctgccagacaagcaaagaatcaagctgtatatttaaaacttggctgttaacc

SEQ ID NO: 11931 - DNA, 464 bp, Homo sapiens
taagctcgggaattcggctcgagcttattaaaactttcccaattaattttaactgtgttattgaatttacttttactaaactactgttctctttgtctcttttttaactaggctctgattttgacccctaatttaagctttaagaatagaaatcagctaatatagaatcagacaaaaaggggattaaatgagcagtttgagttacattattttattgtattaaatttatttgatttatattgtcatgttctcttgccagagagaatctgtaggaaaatactgtatcttgtatactgatcattggctttttctagaaaaactgtctctgattctggacaaagctcagttatagttacgagaaagatatggtacagggaggaaaatactgcctttttttttttttaaaaaaatttttaaaacaaaaaaaaagggcaaaaagggggtttaaggggttttttttaaaa

SEQ ID NO: 11932 - DNA, 516 bp, Homo sapiens; identical to SEQ ID NO: 3419

SEQ ID NO: 11933 - DNA, 507 bp, Homo sapiens; identical to SEQ ID NO: 645

SEQ ID NO: 11934 - DNA, 567 bp, Homo sapiens; identical to SEQ ID NO: 3429

SEQ ID NO: 11935 - DNA, 554 bp, Homo sapiens
atttaaaagggacgcgaataagtttgctccttcatataagtaattattctatataggaccattatgtttggatcattaaatacctatatgaatatgagatctgaagcacgtcaagttgaaattaggtacagctgttgctccttagcaggctatgaagttgcaatgcttcacatctcttcactacttaaagtgctatttcttgcattcatttctcttgcaataaagcttcatttttttttccccttgagagtatatattttcccctacggttttaaaaaacagataaaacatggacaatggcagaggacttttttggtcttttagtattgaacatgaaatttgtatttaacactgtatcatttatcaggattcattgatcaaatatttcaacctttcatatttttaagaaaacacccatatatattgaaatgcaaacttaaacatattctgttcacttgagtgtaatacttgatgcatgcacacacacacacacataccttctttatagctacaaagtcagggcgttcataggcaaaatctgacaagactgaaac

SEQ ID NO: 11936 - DNA, 217 bp, Homo sapiens
tacaaatttttaaaaatcacaaattggtatccatgtataattcatttccgtgcattttcttgtgtgaagaaagctcagtaaaagtatttcttaggtttctgtaattctagttctctactcgattttcttctgcaattttctgagccagaacccttcttagaaggcatattagagactttaaaagttaaataataaaataaatctcttctttaaacag

SEQ ID NO: 11937 - DNA, 640 bp, Homo sapiens
tttgaaaaggcctctgtggagtaccaggaacacctgtgtgccatgacaggtgttgattgctgcatctccagctttgacaaatcggtgctcaccttagccagtgctgggtgtaagagtgccagcctgaaacattgtctgaatggtgaatccagaaaaagtgtgctgtccaaaccgactgactcttcccctgaggttataaattatttaggaaacaaagcatgtgagtgctacatctcaactgccgattgggctgctgtgcaggaatggcagaacgctatccatgacttgaaaaagagtaccagtagcacttccctcaacctgaaagctgacttcaactatataaaatcattaagcagctttgagtctggaaaatttgtcgaatgtaccgagcaattagaattgttaccaggagaaaatatcaatctacttgctggaggatcaaaagaaaaaatagacatgaaaaaactgcttcgtaacatgtgaagtccagatccaagggaacctcagaaatccattgaagttccattgttaagaagttctgtttgtttggcaactgctttaaacccgatagaacaagatcagaagtggcagtctataactgaaaatgtggtaaagtacttgaagcaacatcccgcatcgc

SEQ ID NO: 11938 - DNA, 502 bp, Homo sapiens; identical to SEQ ID NO: 3440

SEQ ID NO: 11939 - DNA, 165 bp, Homo sapiens
tcagtggctttgctaccctgtgtgctctgaaagcacaggacgagtcttgtttgctcctgaatcctcatctgtcagggctggtcaggcacatagatgctacatggttagtaaatatttgtgcaatataaaggttggacttctttgttactatcattacagcttctt

SEQ ID NO: 11940 - DNA, 343 bp, Homo sapiens
gaatactcacaccacaagaaggacaaacttgtgcacatgtccaagaaagaaagcttcttgattgaggtagcatgaaggatgaggcttcagcccccattgtcttatgtagaatgtggcaatgccaactggagaaagggaagaaggacatattaccttggtttgaatccctgagttctgtactgttctgttttgtttagtctagccacagttcttcacaaaggaaaaaaaaatgtgtagatgataccatgacttttgttaaagccatgacttttgtttgcttggcaaacaaaccctttttttaaaactttgatatttttttttttaaaaattttttttccctttc

SEQ ID NO: 11941 - DNA, 243 bp, Homo sapiens
atcagacatacacacattagatagataaatttagaggacaaaataaggaacatgaaaagcaaatagtagatggcaaatgtaatataatatactatgcataaattttaacaacacacaatattatattgcatattgcccaataagcagaagccataaggtctcacacttttcttataatgcaatagaataaaaatgacaacaaagtaaaagggtatcccaaaaataaaactatccttttggaaa

SEQ ID NO: 11942 - DNA, 605 bp, Homo sapiens
cgagcaaacgtccagcctgggacttaaagggtcagttatgtgacctaaatgcagaactaaaacggtgccgtgagaggactcaaacgttggaccaagagaaccagcagcttcaggaccagctcagagatgcccagcagcaggtcaaggccctggggacagagcgcacaacactggaggggcatttagccaaggtacaggcccaggctgagcagggccaacaggagctgaagaacttgcgtgcttgtgtcctggagctggaagagcggctgagcacgcaggagggcttggtgcaagagcttcagaaaaaacaggtggaattgcaggaagaacggaggggactgatgtcccaactagaggagaaggagaggaggctgcagacatcagaagcagccctgtcaagcagccaagcagaggtggcatctctgcggcaggagactgtggcccaggcagccttactgactgagcgggaagaacgtcttcatgggctagaaatggagcgccggcgactgcacaaccagctgcaggaactcaagggcaacatccgtgtattctgccgggtccgccctgtcctgccgggggagcccactccaccccctggcctcctc

SEQ ID NO: 11943 - DNA, 340 bp, Homo sapiens
ccctggccattagccctgacgccaaagtctgcttctcctgctgcagcgatgggaacattgctgtctgggacctgcacaaccagaccctggtcaggcagttccagggccacacagatggggccagctgcatagacatctcccatgatggcaccaaactgtggacagggggcctggacaacacagtgcgctcctgggacctgcgggagggccgacagctacagcagcatgacttcacttcccagatcttctcgctgggctactgccccactggggagtggctggctgtgggcatggagagcagcaacgtggaggtgctgcaccacaccaagcctgacaagta

SEQ ID NO: 11944 - DNA, 626 bp, Homo sapiens
tgcaggtcctggtgcttgatggtcgaggccatctcctgggccgcctggcggccatcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcct

SEQ ID NO: 11945 - DNA, 628 bp, Homo sapiens
ctctcaaaggcctttgtgggccagaagagttccttcctggtggactgcagcaaagctggctccaacatgctgctgatcggggtccatgggcccaccaccccctgcgaggaggtctccatgaagcatgtaggcaaccagcaatacaacgtcacatacgtcgtcaaggagaggggcgattatgtgctggctgtgaagtggggggaggaacacatccctggcagcccttttcatgtcacagtgccttaaaacagttttctcaaatcctggagagagttcttgtggttgcttttgttgcttgtttgtaattcattttatacaaagccctccagcctgtttgtggggctgaaaccccatccctaaaatattgctgttgtaaaatgccttcagaaataagtcctagactggactcttgagggacatattggagaatcttaagaaatgcaagcttgttcagggggctgagaagatcctgagtacactaggtgcaaaccagaactcttggtggaacagaccagccactgcagcagacagaccaggaacacaatgagactgacatttcaaaaaaacaaaactggctagcctgagctgctggttcactcttcagcatttatgaaacaaggctagggga

SEQ ID NO: 11946 - DNA, 388 bp, Homo sapiens; identical to SEQ ID NO: 328

SEQ ID NO: 11947 - DNA, 480 bp, Homo sapiens
tcgaattcttctgatcataatttgtttagtgctacatttgataatttattatttacagcttagaatattgatttcttgaatacgtataagcacatttgactgtcttttatatatggattactgcattccattgattcttattttgtggttggctttatttctttcacaactgtgtaagtttaaagagctaaagctctaaaactgttctgagaaacaatgaatagtacatgtatatgtatatttttaaactgccttattgctcaatgagttgctgttcctggagtatctaactttcagtttactcaaaaacttttgggtaaataaaaaagggaagtacagatagtttaggttgtgcatggttgcatgaattttgaagtcatttctatgtggagcattatttttcttcttgttaaatatagaaaaaaaaagagattctagtacaaagttactgtttaacaaaagcaacataaactctgggaa

SEQ ID NO: 11948 - DNA, 1418 bp, Homo sapiens
cttttcctgtggcagcagccgggctgagaggagcgtggctgtctcctctctccgccatggcgtgtgctcgcccactgatatcggtgtactccgaaaagggggagtcatctggcaaaaatgtcactttgcctgctgtattcaaggctcctattcgaccagatattgtgaactttgttcacaccaacttgcgcaaaaacaacagacagccctatgctgtcagtgaattagcaggtcatcagactagtgctgagtcttggggtactggcagagctgtggctcgaattcccagagttcgaggtggtgggactcaccgctctggccagggtgcttttggaaacatgtgtcgtggaggccgaatgtttgcaccaaccaaaacctggcgccgttggcatcgtagagtgaacacaacccaaaaacgatacgccatctgttctgccctggctgcctcagccctaccagcactggtcatgtctaaaggtcatcgtattgaggaagttcctgaacttcctttggtagttgaagataaagttgaaggctacaagaagaccaaggaagctgttttgctccttaagaaacttaaagcctggaatgatatcaaaaaggtctatgcctctcagcgaatgagagctggcaaaggcaaaatgagaaaccgtcgccgtatccagcgcaggggcccgtgcatcatctataatgaggataatggtatcatcaaggccttcagaaacatccctggaattactctgcttaatgtaagcaagctgaacattttgaagcttgctcctggtgggcatgtgggacgtttctgcatttggactgaaagtgctttccggaagttagatgaattgtacggcacttggcgtaaagccgcttccctcaagagtaactacaatcttcccatgcacaagatgattaatacagatcttagcagaatcttgaaaagcccagagatccaaagagcccttcgagcaccacgcaagaagatccatcgcagagtcctaaagaagaacccactgaaaaacttgagaatcatgttgaagctaaacccatatgcaaagaccatgcgccggaacaccattcttcgccaggccaggaatcacaagctccgggtggataaggcagctgctgcagcagcggcactacaagccaaatcagatgagaaggcggcggttgcaggcaagaagcctgtggtaggtaagaaaggaaagaaggctgctgttggtgttaagaagcagaagaagcctctggtgggaaaaaaggcagcagctaccaagaaaccagcccctgaaaagaagcctgcagagaagaaacctactacagaggagaagaagcctgctgcataaactcttaaatttgattattccataaaggtcaaatcattttggacagcttcttttgaataaagacctgattatacaggc

SEQ ID NO: 11949 - DNA, 175 bp, Homo sapiens
atattagccaacaatgttttaatatactttatagacaataagtttttttacaatattttatttactcatctaccaataaaacttttctaggaattcaacaataaaccaacattaaaagctttctagcataaatcaccaatttccaagataaccacaggccatctttaaaatacat

SEQ ID NO: 11950 - DNA, 399 bp, Homo sapiens
agctgatgaagatgatgtggacaatgaggaggctgcactgctgcatgaagaggctaccatgactattgaagagctgctgacacgctacgggcagaactgtcacaagggccctccccacagcaaatctggaggtgggacaggcgaggaaccagggtcccagggcctcaatggggaggcaggacctgaggactcaactagggaaactccttcacaagaaaatggccccacagccaaggcctacacaggcttttcctccaactcggaacgtgggactgaggcaggccaagttggtgagcctggcattcccactggtgaggctgggccttcctgctcttcagcctctgacaagctgcctcgagttgctaagtccaagttctttgaggacagtgaggatgagtc

SEQ ID NO: 11951 - DNA, 559 bp, Homo sapiens; identical to SEQ ID NO: 3462

SEQ ID NO: 11952 - DNA, 368 bp, Homo sapiens
catgctctacgtggtggggaagggagatggcaacatccgctactacgaggtgagcgccgacaagcctcacctgagctacctgactgagtaccgctcctataacccacagaaggggatcggtgtcatgccaaagagaggactcgacgtgtcctcctgcgagatcttccgcttctacaagctgatcacaaccaaaagcctcatcgagcccatctccatgattgtgccccggcggtcagaatcctaccaagaggacatataccctccaacagcaggggcccagccctccctgacggcccaggagtggctcagcgggatgaatcgagacccaatcctggtgtcccttaggcctggctctgaactgctgagac

SEQ ID NO: 11953 - DNA, 525 bp, Homo sapiens; identical to SEQ ID NO: 3465

SEQ ID NO: 11954 - DNA, 480 bp, Homo sapiens; identical to SEQ ID NO: 3472

SEQ ID NO: 11955 - DNA, 485 bp, Homo sapiens
ggtggccagccattgtggtgccgccccagcttctggatacagccttttgggtaaacactgggaactccagaagttgtggggagagtggggaatcagacagccgcctctaggggctgggttctgctggggcctccttgttggtgctgtaggcacccgccagggagcagggacccgacttgcagacgcattgcccggtactaggaaggagtgaggtgtgttcccaccgtacacttcccacacgagctgcggctgccagcctcgggccatcagcctaggagagcagatgcagctccaggggctcgacttatagccagttacagctccccggctcttctgtgtggcagagcgtcgtttccgggccctcagggctggggagctcagttcccattgcttgtgctcagggctgagtcttaaagaagggtttgccggccctaacgctgcagcgcgtgcgcggtgagaggccctttttgagcctgtttactcct

SEQ ID NO: 11956 - DNA, 234 bp, Homo sapiens; identical to SEQ ID NO: 25
  misc_feature 146: n = A,T,C or G

SEQ ID NO: 11957 - DNA, 348 bp, Homo sapiens
tttataccctggacccaaagggaggagaagaacttgaacagaaatgcagttaggggtttggattactgccttgtgactaataaataggactagacactttcatccccacatataagacagtcagctcacagagaaaaatgacaaggtgggtctgcaaacaacggaagcactggcgcaccaaaacttgatctacagagccatctgaaactataaacaaatatgctgatgaatattaagaagatgaaagaaagaaaccaaaggtttaaaaatatgatgctgaaaacaatgaaatgtctctaggtaattaaacagtatggcaggtaatctaatttaaaactaaaacccagc

SEQ ID NO: 11958 - DNA, 541 bp, Homo sapiens
tccctattagctaaaagcccattaagacaagaaacacagaagcccctggtcccagagaagaagcaaagggccaggtagaggccagaagggagtctttggatcctgtccaggagcctgggggccaggcagaggctgatggagatgttccagggcccagaggggaagctgagggccaggcagaggctaaaggagatgcccctgggcccagaggggaagctgggggccaggcagaggctgaaggagatgcccccgggcccagaggggaagctgggggccaggcagaggccagggagaatggagaggaggccaaggaacttccaggggaaacactggagtctaagaacacccaaaatgactttgaggtgcacattgttcaagtggagaatgatgagatctagatcttgaagatacaggtaccccacgaagtctcagtgccagaacataagccctgaagtgggcaggggaaatgtacgctgggacaaggaccatctctgtgccccctgcctggtcccagtaggtatcaggtctttctgtgcagctc

SEQ ID NO: 11959 - DNA, 534 bp, Homo sapiens
ccaccctggtggccctgctggccgctcggaccaaagtgatccatcggctgcaggcagcgtccccagagctcacacaggccgctatcatggagaagctggtggcttactcatccgatcaggcacactcctcagtggaaagagctgggttaattggtggagtgaaattaaaagccatcccctcagatggcaacttcgccatgcgtgcgtctgccctgcaggaagccctggagagagacaaagcggctggcctgattcctttctttatggttgccaccctggggaccacaacatgctgctcctttgacaatctcttagaagtcggtcctatctgcaacaaggaagacatatggctgcacgttgatgcagcctacgcaggcagtgcattcatctgccctgagttccggcaccttctgaatggagtggagtttgcagattcattcaactttaatccccacaaatggctattggtgaattttgactgttctgccatgtgggtgaaaaagagaacagacttaacgggagcctttagactgg

SEQ ID NO: 11960 - DNA, 344 bp, Homo sapiens
atggaggcttcacaaccaggtgaaggctcgggaggcgagtctgctggaggtggagacaaagtctctgaaactggaacattcctgatctctccccacacagaggccagcagacctcttcctgaggacttctgtttaaaggaggacgaggaggaggttggtgacagtcaggcctgggaggagcccacaaactggagcacagagacatggaacctagctacttcctgggaggtggggcggggactacggagaaggtgcagccaggctgtggcaaagggccccagtcacagccttggctgggaaggagggacgacagctgaaggtcgactaaaacaaagtctgttttc

SEQ ID NO: 11961 - DNA, 480 bp, Homo sapiens
  misc_feature 441: n = A,T,C or G
catcccgtgggtgctggctgccaagtcttcgaaggccgacccaagctggccacatggcggcagcgcgtggaggcagcagtgggggaggacctcttccaggaggcccatgaggtcattctgaaggccaaggacttcccacctgcagaccccaccataaagcagaagctgatgccctgggtgctggccatgatccggtgagctgggaaacctcacccttgcaccgtcctcagcagtccacaaagcattttcatttctaatggcccatgggagccaggcccagaaagcaggaatggcttgcttaagacttgcccaagtcccagagcacctcacctcccgaagccaccatccccaccctgtcttccacagccgcctgaaagccacaatgagaatgatgcacactgaggccttgtgtcctttaatcactgcatttcattttgattntggataataaacctgggctcagcctgagcctctgcttct

SEQ ID NO: 11962 - DNA, 506 bp, Homo sapiens
agctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcatt

SEQ ID NO: 11963 - DNA, 650 bp, Homo sapiens
ccgggtagaagtggaggggccgttcgaagagtcgtgagggggtgacgggttaagattcggagagagaggtgctagtggctggacttgacctggaaagaatcttctgctgactctcaacttttcctggaaaaaatggatcattcccaccatatggggatgagctatatggactccaacagtaccatgcaaccttctcaccatcacccaaccacttcagcctcacactcccatggtggaggagacagcagcatgatgatgatgcctatgaccttctactttggctttaagaatgtggaactactgttttccggtttggtgatcaatacagctggagaaatggctggagcttttgtggcagtgtttttactagcaatgttctatgaaggactcaagatagcccgagagagcctgctgcgtaagtcacaagtcagcattcgctacaattccatgcctgtcccaggaccaaatggaaccatccttatggagacacacaaaactgttgggcaacagatgctgagctttcctcacctcctgcaaacagtgctgcacatcatccaggtggtcataagctacttcctcatgctcatcttcatgacctacaacgggtacctctgcattgcagtagcagcaggggccggtacaggatactt

SEQ ID NO: 11964 - DNA, 425 bp, Homo sapiens
gagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaaagtccctggtggttctgcgccttcccctacagcctcctcatcttcatctatgatgaggtccgaaagctcatcctgcggcggtatcctggtggctgggtggagaaggagacatactactgaccccattggaagaagaaccaggcatggaaagatggggagctctggaggtgttgtggggatggtgat

SEQ ID NO: 11965 - DNA, 275 bp, Homo sapiens
gcagccggctgccgctcccgacttttccttctccaaggagcagaggagtggctggcacaagggtcagctgtccaacggggaaccagggctggctcggtgggacagggcctcagaggtgaggaagatgggagagggacaagcagaggcaaggcctgcctgagactgaggaaggaaaggggtttgaccactcccgaggctgccatgcggtgggaccaccctgctgtccgtctcctgtggctgcccctctgcccgctcctgatggctcgccttgtctc

SEQ ID NO: 11966 - DNA, 400 bp, Homo sapiens
tgatatgagctatgtgcatcgtgatctggccgcacggaacatcctggtgaacagcaacttggtctgcaaagtgtctgattttggcatgtcccgagtgcttgaggatgatccggaagcagcttacaccaccaggggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcgctccaccagctgatgctagactgctggcagaaggagaggagcgacaggcctaaattt

SEQ ID NO: 11967 - DNA, 536 bp, Homo sapiens
aagctcgggattcggctcgaggacgagtccaaccatgaccctcagtttgagccaatagtttctcttcctgagcaagaaattaaaacactggaagaagatgaagaggaactttttaaaatgcgggcaaaactgttccgatttgcctctgagaacgatctcccagaatggaaggagcgaggcactggtgacgtcaagctcctgaagcacaaggagaaaggggccatccgcctcctcatgcggagggacaagaccctgaagatctgtgccaaccactacatcacgccgatgatggagctgaagcccaacgcaggtagcgaccgtgcctgggtctggaacacccacgctgacttcgccgacgagtgccccaagccagagctgctggccatccgcttcctgaatgctgagaatgcacagaaattcaaaacaaagtttgaagaatgcaggaaagagatcgaagagagagaaaagaaagcaggatcaggcaaaaatgatcatgccgaaaaagtggcggaaaagctagaagctctctcggtgaa

SEQ ID NO: 11968 - DNA, 220 bp, Homo sapiens
gcttctatgaccaaaatgagttgtaaattctctggtgcaagataaaaggtcttgggaaaacaaaacaaaacaaaacaaacctcccttccccagcagggctgctagcttgctttctgcattttcaaaatgataatttacaatggaaggacaagaatgtcatattctcaaggaaaaaaggtatatcacatgtctcattctcctcaaatattccatttgcaga

SEQ ID NO: 11969 - DNA, 91 bp, Homo sapiens
atctccgaagacttgaacactcactccacaacccaagaatctgcagctaacttattttcccctagctttccccagacaccctgttttattt

SEQ ID NO: 11970 - DNA, 506 bp, Homo sapiens; identical to SEQ ID NO: 3522

SEQ ID NO: 11971 - DNA, 227 bp, Homo sapiens
aaattatttgattattccaaaccatcagcaaaaagagccttcaaatacattcaggaagctgaaatgttacgttccatctcttttcatccttctggagactttatacttgtcggaactcagcatcctactcttcgcctttatgatatcaacacctttcaatgttttgtctcttgcaatcctcaagatcaacacaccgatgctatatgttccgttaattacaattctag

SEQ ID NO: 11972 - DNA, 431 bp, Homo sapiens
cttacgttactatccccaacatgcccattcgctttaccaagatcttgtacaatcagcaaaaccactatgatggctccactggtaaattccactgcaacattcctgggctgtactactttgcctaccacatcacagtctatatgaaggatgtgaaggtcaacctcttcaagaaggacaaagctatgctcttcacctatgatcagtaccaggaaaataatgtggaccaagcctccggctctgtgctcctgcatctggaggtgggcgaccaagtctggctccatgtgtatggggaaggacagcgtaatggactctatgctgataatgacaatgactccaccttcacaggctttcttctctaccatgacaccaactgatcaccactaactgatagcctacttcaggccaaacagccccaaagtcaattaaaggct

SEQ ID NO: 11973 - DNA, 540 bp, Homo sapiens
ccacagttccctgcagccaatcagggctgaaaatgcagattaccgcacaaatctctttgtacctacagttgaagctaatgttgagactgagacttacgaaactgtgaatcccactgggaaaaagactttttgtacatttggaaaagacaagcgagagcacactattctcattgccaacgttaaaccttatttaaaagccaaacgtgccctgagccctctcctccaagaggtcccctcagcatcaagcagcccaaccaaggcgtgcatcgagccttgcacctcaacaaaaggctccctggatggctgtgaagcaaaaccaggagccctggctgaagcaagcagtcagtacttgcccactgacagtcaatatctgtcacctagtaagcaaccaagagaccctcccttcatggcttccgatcagatggcaagggtctttgcagatgtgcattccagagccagccgggattccagtgagatgggtgctgttcttgagcagcttgaccaccccaacagggatctgggcaaaaagtctgtggatgc

SEQ ID NO: 11974 - DNA, 627 bp, Homo sapiens
ctggcttctatgctcccaagcccatcttctaggcacccagattgaggctccatggcaagcagcagggacaggggcagcaggtagcctgaccccaggaaagagatgtgggtgaccttgcatgtctccaggttacatccactaccagcctgcccaggaccggctgcaaccccacctcctggagatgctgattcagctgccggccaactcagtcaccaaggtttccatccagtttgagcgggcgctgctgaagtggaccgagtacacgccagatcctaaccatggcttctatgtcaggtgggctccacccccacaggccacctctcatccccctgacctaccctctctgctgcttaccccttgatagggcagccagatgggaacacgggccatctctctgcttctctgtagcccatctgtcctcagcgcccttgtgcccagcatggtagcagccaagccagtggactgggaagagagtcccctcttcaacagcctgttcccagtctctgatggctctaactactttgtgcggctctacacggagccgctgctggtgaacctgccgacaccggacttcaacatgccctacaacgtgatctgcctcacgtgcactgtggtggccgtgtgcta

SEQ ID NO: 11975 - DNA, 202 bp, Homo sapiens
ctgttttatttcagggttaccatccattgacccatcaggcagctccccatcttcctcttctgctcctctggcaagtttttccggcataccaggaacaagggttttcctgcaagggccagctcctgttgggactcctagtttcaacagacaacatttttctccccatccttggacaagcgcctcaaactcatgtaggaatcct

SEQ ID NO: 11976 - DNA, 263 bp, Homo sapiens; identical to SEQ ID NO: 3542

SEQ ID NO: 11977 - DNA, 316 bp, Homo sapiens; identical to SEQ ID NO: 2636

SEQ ID NO: 11978 - DNA, 562 bp, Homo sapiens
gcatgttttctcagcaaacacaatgggttataaatgtgtggtctgaggaaaggtatgtgatgattcatgggtcattcgtttacacatgagccggattcacggaggggcacatttaaataactttcttttctggtgtcggacatgcaaaaaggagttaacaaggtaaagatactatcatggcacatgtgactgaatttcataatggacacagatatttttatgagatggatgaggtagaaggtgaaactttgccatcatcctctacaacattggataatttgactgctaacaagccttcatcagctattactgttattgatcattccccggcaaatagttctccgaggggtaaatggcaatgccggatttgtgaagatatgtttgattcccaggaatatgtaaaacagcactgcatgtctttggcaagccacaagtttcatagatacagctgtgctcactgcagaaagccttttcataagatagaaacattgtaccgacattgccaagatgagcatgacaatgagataaagattaaatacttctgtgggctttgtgatcttat

SEQ ID NO: 11979 - DNA, 278 bp, Homo sapiens
  misc_feature 44: n = A,T,C or G
acattttcctcattgttccattgtaaatattcctcttgttggantctttttaatcctgagatttaaacctgtacctttcaattgtctgtgacctttcaatttcactttcaatagttgaagaacttggctttgtaaatctctcagaagcttgaaaatatcttgtctctaccccctcagcccatttcatttgccaataattattttgtaagtagggttgaaatgaactcagctggccttgtgaaatgtttaaacttgcacaaacaactacatttttgttc

SEQ ID NO: 11980 - DNA, 480 bp, Homo sapiens
agaagacaaaatgttttattttaaaacattgaaaaaacattaaaagacaaatgtccattatgtaaccaggaatgttaaatatatggaaacggtaaatctctaaaatgtggtaggtacttccagagctaaatgttgcaagttatcctacttttttctctaatatcaacaatacctgatacgatgaaaaataacaaaaagaccttactaattatccaatcaaagtcatcatctttgggtaaatttatatcaacacaacttaaagttttgtccaagatgttcctgacacatgaagcttccagttgaatttcagaaatgttaacaaaagtatcttccttttttgcctgtgaatgtttgagtattgctgtattgttggcttatatccactacagatactggttctaggccagcccaaggatcttcaagcattgaaggcttgaaataattttccaactcattagacattcttttttctctaacacg

SEQ ID NO: 11981 - DNA, 278 bp, Homo sapiens
  misc_feature 253, 258, 259, 260, 262, 265, 267: n = A,T,C or G
attttgaaaataacaactaaaagatgtataacatagcaaaactgcttaaacatcccattttgacacttgtcttgcagttagtttgacattttgtagttaatgattccaaattggtttagttgggccatctcattcttcacttcctgtaaaccactccatagatttgtctttcttcaagaaattagttttctttcctttatttgattgatggtcattgactactgaaataaaatatgcatttaagataaaaaanaaaannnanaananaaaaaagggcg

SEQ ID NO: 11982 - DNA, 496 bp, Homo sapiens
acccccttgctcactctcttgctcacagtccagatggcccggtccctggtgtgccttggtgtcatcatcttgctgtctgccttctccggacctggtgtcaggggtggtcctatgcccaagctggctgaccggaagctgtgtgcggaccaggagtgcagccaccctatctccatggctgtggcccttcaggactacatggcccccgactgccgattcctgaccattcaccggggccaagtggtgtatgtcttctccaagctgaagggccgtgggcggctcttctggggaggcagcgttcagggagattactatggagatctggctgctcgcctgggctatttccccagtagcattgtccgagaggaccagaccctgaaacctggcaaagtcgatgtgaagacagacaaatgggatttctactgccagtgagctcagcctaccgctggccctgccgtttcccctccttgggtttatgcaaatacaatcagcccagtgc

SEQ ID NO: 11983 - DNA, 442 bp, Homo sapiens
taagctcggaattcggctcgaggctgggggtgacaggctcatccatgagcaggacctggagtggctgcagcaggcggacgtggtcgtggcagaagtgacacagccatccttgggtgtaggctatgagctgggccgggccgtggcctttaacaagcggatcctgtgcctgttccgcccgcagtctggccgcgtgctttcggccatgatccggggagcagcagatggctctcggttccaggtgtgggactatgaggagggagaggtggaggccctgctggatcgatacttcgaggctgatcctccagggcaggtggctgcctcccctgacccaaccacttgacttaatctcactttcttaaattcttctattctcagacactgctctagtaccattccttcctcttagccccaggagcaaattaaaaggtacagttaaaatcct

SEQ ID NO: 11984 - DNA, 427 bp, Homo sapiens; identical to SEQ ID NO: 3568

SEQ ID NO: 11985 - DNA, 493 bp, Homo sapiens; identical to SEQ ID NO: 3570

SEQ ID NO: 11986 - DNA, 553 bp, Homo sapiens
taagctcggaattcggctcgagagctgggctgtcccttcagcccccacctgtcccttcctatgccctcagtgtctcgaagtacctcccgcagcagtgccaattgggaaaggcttcggcaagggaccctgaggagagacctgcgtgggataatcaacaggggtctggaggacggggagagctgggaatatcagatctgactgcgtgttctcacttcgcttcctggaacttgctctcattttcctgggtgcatcaaacaaaacaaaaaccaaacacccagaggtctcatctcccaggccccaggggagaaagaggagtagcatgaacgccaaggaatgtacgttgagaatcactgctccaggcctgcattactccttcagctctggggcagaggaagcccagcccaagcacggggctggcagggcgtgaggaactctcctgtggcctgctcatcacccttccgacaggagcactgcatgtcagagcactttaaaaacaggccagcctgcttgggcgctcggtctccaccccagggtcataagtggggagagagcc

SEQ ID NO: 11987 - DNA, 391 bp, Homo sapiens
taagctcgggaattcggctcgagcagctgcacacctatgtctgcctgatggcctcacccagcgaggaggagccccgtccgcgagaggacgacgtccccttcactgcccgggtcggcggtcgcagcctcagcacgcccaacgccctcagctttggctccccaaccagcagcgatgacatgaccctcaccagccccagcatggacaactccagcgcagagctacttcccagcggggactcgccactgaaccagaggatgacggagaacctgctggccagcctgtcggagcatgaacgcgcagccatcctcagtgtacccgcagcccagaaccctgaggacctccgcatgtttgccaggctccttcactacttccgcggccgccgactagtgag

SEQ ID NO: 11988 - DNA, 248 bp, Homo sapiens
  misc_feature 146, 209, 215: n = A,T,C or G
gaacgtgtgggtgggtctcccccagccctccctcctggcgggtctcctccagcctcacttcgctgccacttcgccgctgccccggagacttttcaatcccaccccactcctcatctcaccatttggtcaaattggaagcccagggncaggaccccgaggtttagaagatgcttgggcttggagggaggagggccggcgaggctagcgangggacnggagacggccctgctgcggacggagcgcggaaa

SEQ ID NO: 11989 - DNA, 540 bp, Homo sapiens
ggaaaaatgagcacacataatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatggactacggaaagaagtggtggacacaagcccaagcccacgacctggtcatcaaaagccttgacaaattgaaggaggtgagggag

SEQ ID NO: 11990 - DNA, 81 bp, Homo sapiens
tggtacgcctgcaggtaccggtccggaattaattcccgggtcgacgagctcactagtcggcggccgcccttttttattttt

SEQ ID NO: 11991 - DNA, 597 bp, Homo sapiens
ctggtacgcctgcagtaccggtccggaattcccgggtcgacccacgcgtccgtgcccttcgtccgtggccagagcttctcagtgtggatcttgtgtgaagctcactgcctcaaggtggccgtggatggtcagcacctgtttgaatactaccatcgcctgaggaacctgcccaccatcaacagactggaagtggggggcgacatccagctgacccatgtgcagacataggcggcttcctggccctggggccgggggctggggtgtggggcagtctgggtcctctcatcatccccacttcccaggcccagcctttccaaccctgcctgggatctgggctttaatgcagaggccatgtccttgtctggtcctgcttctggctacagccaccctggaacggagaaggcagctgacggggattgccttcctcagccgcagcagcacctggggctccagctgctggaatcctaccatcccaggaggcaggcacagccagggagaggggaggagtgggcagtgaagatgaagccccatgctcagtcccctcccatcccccacgcagctccaccccagtcccaagccaccagctgtctgctcctg

SEQ ID NO: 11992 - DNA, 138 bp, Homo sapiens
cacctccatccatgaagcagtcaccaaaatccagtgaagaaacaccacccgtccagtaccaccaaagtagttctctgtcatgtgtgttccctgcctgcacaaacctacatgtacataccatggattagagacacttgc

SEQ ID NO: 11993 - DNA, 589 bp, Homo sapiens
tggtacgcctgcaggtaccggtccggaattcccgggtcgacccacgcgtccgcttaagtagccattggaaatttatattcttaactaggtcaaaaaataatgagccataagtttatgtcctctcacttagacattttctctttaaaaaggtattttcttctttataaacattttaaaagagccttcccttcttaaactaactccagtgcatgaagtgtgaaaatattttaaaatgacatttttactaatatgagcaagtcatgtaaacattgaagaacttggtaacatattagtaaatggatattaccaaatgttttcatcgttaattactttgcgttccaccaaaatatctttactaaaatgtgcttggtgtagtttgtttattgtctaaattagtaccagtcatcttatttctgcaaaatgagtatcaatgtgaaaaagacacgtgaagattaagcatgtttgaaaataaaatggtcaattacatttcaatttacataggccaacaactgttccatactttgtttgtaaacatttaatttctctactggacaaaattaatatttggctttacattgaattttgagct

SEQ ID NO: 11994 - DNA, 185 bp, Homo sapiens
  misc_feature 46, 178, 181: n = A,T,C or G
gggaactgggaacagccaggtgccccaaagcaaatacgcggagtgnctggccatcattgaagagctggggaaggagatcagacccacgtacgcaggagcaagagtgccatggagaggctgaagcgcggcatcattcacgctagaggactggttcgggagtgcttggcagaaacggaanganatgc

SEQ ID NO: 11995 - DNA, 285 bp, Homo sapiens
  misc_feature 25: n = A,T,C or G
agagattgctaatgagatgattgangcagccaaggccgtctatacccaggattgccccctggcagcagcgaaagccatccagggcctacgggctgtgtttgatgagacctatcctgaccctgtgcgagtcgtctccattggggtcccggtgtccgagttgctggatgacccctctgggcctgctggctccctgacttctgttgagttctgtgggggaacgcacctgcggaactcgagtcatgcaggagcttttgtgatcgtgacggaagaagccattgccaaggg

SEQ ID NO: 11996 - DNA, 157 bp, Homo sapiens
tgtctgtggacaaagaactctgcagtggttcttatttgcatgatttctgctggtggaggctgtaaatgtgagctcaaactcccacataagtgagttttcattgtaatccagaatgtttttaaatcaccctacttctattgaacttgcactatcatct

SEQ ID NO: 11997 - DNA, 231 bp, Homo sapiens
atcagttacagcaatcattcaatctgaaacagggaaatggcacaatctgaagagatgtggtatatgatcttaaatgatgaacatgagaccgcaaaaattcactcctggagatctccgtagactacaatcaatcaaatcaatagtcagtcttgtaaggaacaaaaattagccatgagccaaaagtatcaataaacggggagtgaagaaacccgttttatacaataaaaccaa

SEQ ID NO: 11998 - DNA, 266 bp, Homo sapiens
gagggcgctcctgtttttaaaacattttgaaaacccctggctgaacagtgctctgcctctaactccctcctcacactccagaattacccttcctcatctgtgcctgtctgtccaacccctcccccacgtctctctgcctgctgggctcttaactgttgctcgaagactgtgacatcagaagtaactcccactcctaatcaagagtctctccagcctcacagatgctggcctcttggcacctgcctagctcttgggcctgacctcca

SEQ ID NO: 11999 - DNA, 183 bp, Homo sapiens
ggccgcccttttttttttttgggccccccccgttttggggggggttgcccccaaatcccttttttaaaacctttcaaaaaaaggggccttttccaaaaatttttaaaaaggccttttggggggccaaaattttggcccagggaaccctttttaaaaaaaccatggggttttttaaaaccgggg

SEQ ID NO: 12000 - DNA, 498 bp, Homo sapiens
cctgctattagaccaccccctcatggcacaactgcccctcacaagaattcagcttcagtgcaaaattcatctgttgcagtcctcagtgtcaatcacattaaaagacctcacagtgttccctcttctgtccagctaccttcgaccttaagtacacaaagtgcttgtcagaattcagtacatccagcaaataagcctattgctcccaatttcagtgcccccttaccatttgggccctttagcacattgtttgaaaacagccctacttctgctcatgccttctggggaggatctgttgtttcatctcagtcaacaccagaatctatgctatcaggaaaatcctcatatttgccaaattcagatcctttacatcagtctgatacttccaaagctccaggttttagaccaccattacagagacctgctccaagtccctcaggtattgtcaatatggactcgccatatggttctgtaacaccttcttcaacacatttgggaaac

SEQ ID NO: 12001 - DNA, 495 bp, Homo sapiens
ccaagccccacttacaagatgtaggcgatgacacctatggaccagcaatccacagccttgctgtagggcttctgggccaggacttcaggggctgtggagggaagaggacgtggtggtgacaaatctctgcccttcaactcctggttccccccaccatcacagccccagcccagggccctccgcacccacgtatcccggagttccacaggcggtggagagcacactgcccgggtcctccatcttggagaggccaaagtcggagatcatgattttggagtcttcatccaggctgtagtacagcagattctctggcttgaaggtcaggagggaagagaaggggcaatcagagatggttggaggctggtagaaccttctgccgctccaagcaccttctgagaaataatggatccccaaaagccactgtggcttcatggctgtcataagaaaatcaaggaagctctcaagaaggccaaaaattccaggaaggacaaggct

SEQ ID NO: 12002 - DNA, 627 bp, Homo sapiens
cccccggcatgcaggaattcggcacgcttggttccgcgttccctgcacaaaatgcctggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgaga

SEQ ID NO: 12003 - DNA, 355 bp, Homo sapiens
  misc_feature 94, 277, 351: n = A,T,C or G
gaagagatcggcacagacccaagcatgaccccagcacgtgggagtgatgtgttggaggtgtgcaccaggctcttgaggcgctggctctgcactncaggcatagcacctttcctgcccacaggacaacgaggccctcttggaggaggcgaagatgatgaacagactgagacacagccgggtggtgaagctcctgggcgttcatcatagaggaagggaagtactccctggtgatggagtacatggagaagggcaacctgatgcacgtgcttgaaagccnagggtagagagggcccctccgcacggggattccccagcgctttgggccctggctgttttgtttattggctcccntttg

SEQ ID NO: 12004 - DNA, 519 bp, Homo sapiens; identical to SEQ ID NO: 789

SEQ ID NO: 12005 - DNA, 562 bp, Homo sapiens
  misc_feature 499: n = A,T,C or G
tggtacgcctgcaggtaccggtccggaattcccgggtcgacccacgcgtccgggacattgtggacagcataaaaggagaattatctgggcattttgaagacttactgttggccatagttaattgtgtgaggaacacgccggcctttttagccgaaagactgcatcgagccttgaagggtattggaactgatgagtttactctgaaccgaataatggtgtccagatcagaaattgaccttttggacattcgaacagagttcaagaagcattatggctattccctatattcagcaattaaatcggatacttctggagactatgaaatcacactcttaaaaatctgtggtggagatgactgaaccaagaagataatctccaaaggtccacgatgggctttcccaacagctccaccttacttcttctcatactatttaagagaacaagcaaatataaacagcaacttgtgttccgaacaggaattttcattgttctataacancaacaacaaaagcgattattattttagagcatctcatttataatgtagcagctcataaatgaa

SEQ ID NO: 12006 - DNA, 461 bp, Homo sapiens
tggtacgcctgcaggtaccggtccggaattcccgggtcgacccacgcgtccgtgcctgctcttttctgttggccttggtcacttccatgtgcatgagcatctccatccaaaagtggccttcttctctagccccgatgggatgtcagtagcccatgtttctaatagaagacccatgccaaagccactttgacaactctccagctcgcaggaatgctgtcggcctctagctaaactgttatggtccactcaacgctgtacactgtgtggccactttcctccgcttcctgtacattgtcaggaggttgtaaggcagcaccaggggctgacctctcaggacttgcagcagcagagcccagctgggtacacctgtctaaaaaccacagcacagcagtagctgctcaatggagacattgttctctgcatcccaaagccaggaattcaaaataaagcttggcttccat

SEQ ID NO: 12007 - DNA, 578 bp, Homo sapiens
tggtacgcctgcaggtaccggtccggaattcccgggtcgacccacgcgtccgcggacgcgtggggtcagaagggacaaactgtccacccaaggaacagcctggcgatctttttaatgaggactgggactcggagttgaaagcagatcaagggaatccatatgatgctgacgacatccaggagagcatttctcaagagcttaaaccttgggtgtgctgtgccccacaaggagacatgatctatgaccccagctggcaccatccgcctccactgataccctattattccaagatggtctttgaaacaggacagtttgacgatgctgaagattgagtgtggagctttctgccttgtaggtgggcgggcctccacgtcaagatctcttttcctgtcttggaggtgaaaagtcatatctgagaaaatgtttgcagtgacccctagtctggggtacacagaccagtgttccttattgacagtgttcaataaggccccgtcattctcgccagtctgttgttggtcttaatgggctcctccttgaaatgtgtgtgtgtttgtgtcaagaggagttgtgttctttgt

SEQ ID NO: 12008 - DNA, 495 bp, Homo sapiens
tggtacgcctgcaggtaccggtccggaattcccgggtcgacccacgcgtccgtaagatggaagcgtttttggggtcgcggtccggactttgggcggggggtccggccccaggacagttttaccgcattccatccactcccgattccttcatggatccggcgtctgcactttacagaggtccaatcacgcggacccagaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgattgatgaggagcttctgggagatggacacagctatagtcctagagctattcattcatggctgaccagggccatgtacagccggcgctcga

SEQ ID NO: 12009 - DNA, 489 bp, Homo sapiens
tggtacgcctgcaggtaccggtccggaattcggctcgaggtcctgcaggccatctacgtgattgacttcttctggaacgaaacctggtacctgaagaccattgacatctgccatgaccacttcgggtggtacctgggctggggcgactgtgtctggctgccttatctttacacgctgcagggtctgtacttggtgtaccaccccgtgcagctgtccaccccgcacgccgtgggcgtcctgctgctgggcctggtgggctactacatcttccgggtggccaaccaccagaaggacctgttccgccgcacggatgggcgctgcctcatctggggcaggaagcccaaggtcatcgagtgctcctacacatccgccgacgggcagaggcaccacagcaagctgctggtgtcgggcttctgtggcgtggcccgccacttcaactacgtcggcgacctgatgggcagcctggcctactgcctggcctgtggcggt

SEQ ID NO: 12010 - DNA, 51 bp, Homo sapiens
gccgccttttttttttttttttttttttttttttttttttttttttttttt

SEQ ID NO: 12011 - DNA, 270 bp, Homo sapiens
  misc_feature 256, 263: n = A,T,C or G
ggcccaggggcccctggagccccaggccccaaaggtgaatcgggagactacaaggccacccagaaaatcgccttctctgccacaagaaccatcaacgtccccctgcgccgggaccagaccatccgcttcgaccacgtgatcaccaacatgaacaacaattatgagccccgcagtggcaagttcacctgcaagtcaccaccggtggcatggtcctcaagctggagcagggggagaacgtttcctgcaggccacgganaagaaantcattat

SEQ ID NO: 12012 - DNA, 278 bp, Homo sapiens
  misc_feature 24, 33: n = A,T,C or G
ataaatttgacttttctgtaattnaggtttttnctttttttgtaccattttaaagttagtatcttttgatatgcatatttgtttatggtaaaaaatttataacgtgttcaatattttcttttcccccattaatcagttcattagaaatattttaaaatcagctattttgtgaagccatgagttccagaaagtaaaggtgacatcggaaaaataatcaaaagctatttaaagcatctataaggtgcctctttctgtcttctacagatgagtcacacctt

SEQ ID NO: 12013 - DNA, 809 bp, Homo sapiens
tttttttttttttttttttttaaaaggggccacaagctttattaaaagtaaatgcaacagtaatatgtacagatggcacatggtcaattctttatttgtaaatatagtactccaactcaagtttacaagttacacctttgccacagccttggctaaatcttgaactagtgcagaattcagctgtggtagagtgctgatcttagcatgcttcgatgtggcatacttgttcttgacagtcatgtgctttgtaagtccttgatttaccatgactacattcttagccaggtgctgcataactggaagaagagattcttcagtatatgacaggtaatgttgtagagttggtgtccattccaccttaacccggaatttccagtgctaagcaaaaagctcctgctgcaattcgagaaggaggaaagtgcaccatgtcatagtccaacatagttagttccatcaggtatttggccaaagtatgttgctcgacatcaacctctccaatcttagatgctctccgaagaatgtgcaaaggtagaggccgacccagaccaaagtttaaagctcttagaatcttcatttccatctgtctgatttggtgcttagtataagtgttgtcagtcacaaaagcaaagtcaccaatttctggagggtacatttcttcatattggctgcaataaacatggcagtgacaccaaccagctgcagcatcttcttgggcacacaatattctgcatgaaccgttcaaaatggagacagtctgtacatggtctcctgcaacacctgaaattcattgatctgtacaagcagtcaat

SEQ ID NO: 12014 - DNA, 76 bp, Homo sapiens
gggcttattcagttttgattatccatgtctgttttgggagcagataagcaaaactgaataagcccaatcttggcct

SEQ ID NO: 12015 - DNA, 622 bp, Homo sapiens
ggagagtagcagtgccttggaccccagctctcctccccctttctctctaaggatggcccagaaggagaactcctacccctggccctacggccgacagacggctccatctggcctgagcaccctgccccagcgagtcctccggaaagagcctgtcaccccatctgcacttgtcctcatgagccgctccaatgtccagcccacagctgcccctggccagaaggtgatggagaatagcagtgggacacccgacatcttaacgcggcacttcacaattgatgactttgagattgggcgtcctctgggcaaaggcaagtttggaaacgtgtacttggctcgggagaagaaaagccatttcatcgtggcgctcaaggtcctcttcaagtcccagatagagaaggagggcgtggagcatcagctgcgcagagagatcgaaatccaggcccacctgcaccatcccaacatcctgcgtctctacaactatttttatgaccggaggaggatctacttgattctagagtatgccccccgcggggagctctacaaggagctgcagaagagctgcacatttgacgagcagcgaacagccacgatcatggaggagttggcagatgctctaatgtac

SEQ ID NO: 12016 - DNA, 572 bp, Homo sapiens
ccaagaattcggcacgaggaagaaaacaaacaaaacaactgggaagaagctgcaaaattgttgaaggaagcaattaacaaaccatatgaaaaagttcgaatatacagaatggatgggtcatatcgttctgttgaattgaagcatggaaataataccacagtgcagcagataatggaaggaatgcgtctctctcaagaaactcagcaatatttcactatatggatttgttcagaaaacctcagccttcaactcaaaccatatcataaacccttgcaacatgttcgtgactggccagaaatacttgctgaattgactaatctggatcctcaaagggaaacacctcagctttttctaagaagagatgtgagacttcccttggaagttgaaaaacagattgaagacccactagctattcttattctctttgatgaagccagatataatttattgaagggcttttatacagctcctgatgctaagctgataacattggcaagtctgcttttgcaaatagtctatggaaattatgagagtaaaaaacacaagcaaggtttcctaaatgaagaaaatct

SEQ ID NO: 12017 - DNA, 558 bp, Homo sapiens; identical to SEQ ID NO: 336

SEQ ID NO: 12018 - DNA, 177 bp, Homo sapiens
gaaaaatcatgtccaaagtcttgggcatgcttgtcacagccaacatcctgacatggaaagtttatgtttctgtccctgggcctccttctacctcccactaaatcatagacattgccagattgcagaccctgtcttcatagaagtgtgaaatgtaaaagtgtgtgaaagtagtgtctc

SEQ ID NO: 12019 - DNA, 202 bp, Homo sapiens
aaaacagaaatgtcataaaggataactatttgcccttgaaaatagtatagttaatctgttggaacagaacacctttgagaaacatgaaaattatcaagaagaataaaatgcctgaagcagattaaaaacatacatgctgaagaaatgtggagtaaagaagaaatttgggtaggttccttgaagagataaattagagactcca

SEQ ID NO: 12020 - DNA, 188 bp, Homo sapiens
gaagtgcgtaaatattacctatggtagtaaacgtttaattatcattcagtttaaatgttggccttctgtatgtagccaagaacagctcattttgtgaatttcagtttttaagtggctgctttttgatttggttgtattattttattataatgtatttgcaagtatattaaaaaattaacattgagcca

SEQ ID NO: 12021 - DNA, 191 bp, Homo sapiens
aaactaattagtgaagagtaagaaaaaaactagccaacagaattgtaggtgatgcattagttaaatttcaaaactcataataaaggaactttcagagattggttgaaacccagtggtatccctgtaaattagctcctgtgactggaaaagaccccaaaaaggcagtagaggagattagtgtttacttgctg

SEQ ID NO: 12022 - DNA, 528 bp, Homo sapiens
tggtacgcctgcaggtaccggtccggaattcccgggtcgacccacgcgtccggtccaagaagctgttgactggcgtctctttcgtaacatttttatggcctggtttgtcacagtccccatttctggagttatcagtgctgccatcatggcaatcttcagatatgtcatcctcagaatgtgaagctgtttgagattaaaatttgtgtcaatgtttgggaccatcttaggtattcctgctcccctgaagaatgattacagtgttaacagaagactgacaagagtctttttatttgggagccagaggagggaagtgttacttgtgctataactgcttttgtgctaaatatgaattgtctcaaaattagctgtgtaaaatagcccgggttccactggctcctgctgaggtcccctttccttctgggctgtgaattcctgtacatatttctctactttttgtatcaggcttcaattccattatgttttaatgttgtctctgaaaatgacttgtgatttttttttctttttttt

SEQ ID NO: 12023 - DNA, 255 bp, Homo sapiens
ggaacagtcacagtgcaggtgctggaagccatccccaccagcggcctcactgcggcggacgtccctgcgctcgtggacacctgccaacgggccatgaggaccaccttcctccacatctccaagaccccccaggagaacggggccactgcggggtctggcgtgcagccggcccagtagcccagaccacggcagggcatgacctggggagggcaggtggaagccgatggctggaggatgggcagaggggactcctcc

SEQ ID NO: 12024 - DNA, 504 bp, Homo sapiens
cccgggtcgacccacgcgtccgaagagttctgaatatgatgattttttggacgaattcatggaggcagtttcttccaagtatggcatgaattgccttattcagtttgaagattttgccaatgtgaatgcatttcgtctcctgaacaagtatcgaaaccagtattgcacattcaatgatgatattcaaggaacagcatctgttgcagttgcaggtctccttgcagctcttcgaataaccaagaacaaactgtctgatcaaacaatactattccaaggagctggggaggctgccctagggattgcacacctgattgtgatggccttggaaaaagaaggtttaccaaaagagaaagccatcaaaaagatatggctggttgattcaaaaggattaatagttaagggacgtgcttccttaacacaagagaaagagaagtttgcccatgaacatgaagaaatgaagaacctagaagccattgttcaagaaataaaaccaactgccctcat

SEQ ID NO: 12025 - DNA, 480 bp, Homo sapiens
tggtacgcctgcaggtaccggtccggaattcccgggtcgaccccgcgtccgaaattcttcaaactctctgaatggaggcctatttagaaaacatagaaaaagaagaggaacgaaaagatgataatgatgaggaggaggaagatattgatttttttgaagatattgattctgatgaagatgaagggggactgtttggaagtaaaaaacttaagtcaggtaaaagttccagaaatctgaaatacaaagatttttttgatccagttgaaagtgatgaagacataacaaatgttcatgatgatgagctggattcaaacaaagaagatgatgaaattgctgaagaagaagcagaagaactaagtatttcggaaacggatgaagatgatgaccttcaagaaaatgaagacaataaacaacataaagaaagcttgaaaagagtgacctttgctttaccagatgatgcggaaactgaagatacaggtg

SEQ ID NO: 12026 - DNA, 263 bp, Homo sapiens
gcaccacccatcttcactggccggccctttgtggtagcgtgggacgtgcccacacaggactgtggcccacgcctcaaggtgccactggacctgaatgcctttgatgtgcaggcctcacctaatgagggttttgtgaaccagaatattaccatcttctaccgcgaccgtctaggcctgtatccacgcttcgattctgccggaaggtctgtgcatggtggtgtgccacagaatgtcagcctttgggcacaccggaagatgctgca

SEQ ID NO: 12027 - DNA, 297 bp, Homo sapiens
ggccgccctttttttttttttttaaaaaatattattttttttaggggcccttccccccccgggggggggcaagtttttgggccctaaaaaaccttgggtcggaaaaaaaaaggggaaaaaattggcttttcccttttaaaccccggctttttgggggattttgggcccctggggaaccaaccaaaaaaaagggctaaaaccccccccctattttcggttttaaaagggaaaaattcccgggggatttaaaaaacccgggggaaaaggggccccggggggggggaaccccccctccac

SEQ ID NO: 12028 - DNA, 202 bp, Homo sapiens
ccgccgcgggtgtgcggtctcgattcgctgaattgcccgtttccatacagggtctcttccttcggtcttttgtatttttgattgttatgtaaaactcgcttttattttaatattgatgtcagtatttcaactgctgtaaaattataaacttttatacttgggtaagtcccccaggggcgagttcctcgctctgggatgcagg

SEQ ID NO: 12029 - DNA, 465 bp, Homo sapiens; identical to SEQ ID NO: 798

SEQ ID NO: 12030 - DNA, 607 bp, Homo sapiens
ccaagaattcggcacgagaccctgagtatcttcagtcttgaatactcgaaaaagcctggttgccaaaaagccaaactctctttcacaagcatccgagagggttgcaatcatttcagccagagaagtttctccacctacactggacagtctattgtaatctgtaaacaaaaacctcacaggtaaagctttagtagtctgctctggcaactcaggtggattcacaaacatcaatttaaggaggagttccaaatatccaatatgtcttgccaatctagtgctgaggacccaggcccaattccaactctctccttctcttcgtccaccaaagtaaatgacaataaagaatatatataagagagccaagaagctcagtgacactgctattccaagatttgggtggaccgtgaaggcaaacaataaaccaagccctccacaaagtagcagggtaagaaacactatgagccatgagaactgaaagagaggctcaatctgttgtccggcgaaggttttcatttcgtcttctagtttcttgagtaagaaagatttcccacttccccactgtgcatataaccccacacaaatgggtggctgcatggtaggctcactg

SEQ ID NO: 12031 - DNA, 499 bp, Homo sapiens
gtaagattttttttttagcaagcatattaaagataaaatgctatgatattttattaaatgaattaaggtgtttgttgttaaaatgtcttctattttaggacatatagcaacatagttgcttgctgtttatgaatagtgcttaaatattacttcctcatggtctaaaatagtgtccctcaccccactatcactcactgcacctatattttgctttatttttcttcaaaacagtatcactccttctgactatatttattagtctattttcatcaactagattagcctttgttttattcattgctgtgtaatgagtgtctaaagcaatgtgtagcacgttgaaggtattcagtaatttgttaaaagaatgaaagagtaaacatttgccgcttataaaaggaaatatgccaaatttcaagtagatattgaaattatttgaaataactcatgagatatagaggaaggcaagctgttacaatgtagtcatatgcagatgataata

SEQ ID NO: 12032 - DNA, 196 bp, Homo sapiens
  misc_feature 68, 69: n = A,T,C or G
cttagagctcattttgttttatctcctcattgtatggataaagtgtagtgcaaaagagtgagttctannccagaggtaggccaataatttaattttcccaactcacgggccaaggttctttccactgcaccataatactgatccccaattttaaggttccttgtctgtccttctaaaccatcaattcactcaacaa

SEQ ID NO: 12033 - DNA, 290 bp, Homo sapiens; identical to SEQ ID NO: 2542

SEQ ID NO: 12034 - DNA, 264 bp, Homo sapiens
gctggctcttcgcacgcggccatggccgactccgagctgcagctggttgagcagcggatccgcagcttccccgacttccccaccccaggcgtggtattcagggacatctcgcccgtcctgaaggaccccgcctccttccgcgccgccatcggcctcctggcgcgacacctgaaggcgacccacgggggccgcatcgactacatcgcaggcctagactcccgaggcttcctctttggcccctccctggcccaggagcttggactg

SEQ ID NO: 12035 - DNA, 309 bp, Homo sapiens
ggccgcccttttttttttttttttatttttaaaaaccaaaattttttgggttaacaaaccgggaactttttaaaaaaaaacgggttgctgaaaaaggggccttttggggttaaggggtggtcccttccggaaacccatccctaatttgggggttaaaaattttaagggccctttttcacccattccggggggttttccgtttttaacccttggccccccatttatattttttttggccctggggggggaacccccttttcccaagggtcaatttttaaagggggggggcctaaaacccacagggggggc

SEQ ID NO: 12036 - DNA, 292 bp, Homo sapiens; identical to SEQ ID NO: 2876

SEQ ID NO: 12037 - DNA, 264 bp, Homo sapiens
cattctctaactccgtgtgtgatgaaaacgcctccttttctgaccttcaaagtcccctgtagagaccatgcatgctctaagccttagggagtgagaccaacacccatccctgcccagccaacagtggccggggcttgtcttatgtttccatctgttttcttcgtggcattcaatttcatttttttccttttcattttcatgttattttcattattggcaaagaaaatcaaaatgtttatagccaaataacaaatgtgccatgta

SEQ ID NO: 12038 - DNA, 335 bp, Homo sapiens
ggccgcccttttttttttttttttgaaaaaaaattttttttttttgccccgggtgggattaaatggccaaattttgggttgtgggaaccccccccttggggggtaaatttttccggcgggacttcccgggggggggggaaaaaagggccccccccccctggcggggaaatttttgtttttttaaaaaaaagggggttttttttgtttggcccgggttgttcccaacttttttttttaaaaaaattggcgggtttggccccccaaagggggggggttttacaagggggcccccccccccccaccaaaaaacatttttttaaaaagggggggggctt

SEQ ID NO: 12039 - DNA, 253 bp, Homo sapiens
  misc_feature 190: n = A,T,C or G
ccagacccgaattcccagaacctttgaccgcttttgtggcctcatggttcaacttttacacaagctcagtgttcgagcagctgatggcccccagaagcttttgaaggtgaggtattgaaacctgttagttgaaggctggttctgggaatgtttctggggctgacttttctctcttttttactttaggtanttaagaatccagtatcagatcactttccagttggatgtatgaaagttggcacttctttttcat

SEQ ID NO: 12040 - DNA, 479 bp, Homo sapiens
  misc_feature 214, 319, 337, 370, 453, 468, 477: n = A,T,C or G
gtacaagtacttcccttcctcgctctcaccagtgacgccctcagagtccctgccaaggccccgcgaccactgcccacccaacagcagccacagccatcacagaagttagggcgcatccgtgaagatgagggggcagtggcgtcatcaacagtcaaggagcctcctgaggtacagccacacctgagccactctcagatgaggacctacctctggntcctgacctgtatcaggacttctgtgcaggggcctttgatgaccatggcctgccctgggatgagcgacacagaagagtccccattcctgggaccccgcgctgganaggagggcagtgaaagtnaagcatgtgaagcgttcgggagaagaagtcttnagaagaagaaggaggagcgttacaagcggcttcggcagaagcaggaagcacaaggttaattggaaacacccagagagggtttnttgccaaggaccttncttcattgncc

SEQ ID NO: 12041 - DNA, 614 bp, Homo sapiens; identical to SEQ ID NO: 337
  misc_feature 555, 569: n = A,T,C or G

SEQ ID NO: 12042 - DNA, 638 bp, Homo sapiens
  misc_feature 354, 466, 472, 520, 537, 562, 612, 630: n = A,T,C or G
aggaaagaaactaaactgaagatgatgaagaatattaaccaagcaccttttatggacccttgcattcactgataactttctggcagcatctactttttagtgtaactaatgtcaaactgtatcatcaaaaacaaagatctgaaagaaaaaaacatctgatattttaacagctgccaatatctcccacaataactgcgtgaagaaggaattttttaattacttaacctacgtgaaaagaaaagggctaaaagtgatgcctacaaatacattactttctggggaaagaaaagaattccaagaatgtttgcaataatggcctccaatactgaaacaaccaaaagcaggtgaaatganggctgaaatcaaggctgtttcattttagctgaaggacctgcaaagctgcttgggatttctagcagttgaaaacctaacctgcattgatgcttaatcatccatccacatgaanatggcngtcagctatacgcatcaggactcgtttggcaaaaccattgatttttcngtatgtgggataagggnttggggttttttggttttttgggcngtataagggattatgtgtgtgtgagtggggatgtatggatatgggatagncccatttccagggatggntgttgggg

SEQ ID NO: 12043 - DNA, 367 bp, Homo sapiens
  misc_feature 157, 167: n = A,T,C or G
cactgcccacttcctgccctcccgtttggccatgggtgcccccctctgtctcagtgtccctggatcctttttccttggggaggggcacaggctcagctcctctctgaccatgacccaggcatccttgtccccctcacccacccagagctaggggcgngaacagccanccttttggttggcaccgcttctttctgcctctcactggttttctcttctctatctcttattctttccctctcttccgtctctaggtctgttcttcttccctagcatcctcctccccacatctcctttcaccctcttggcttcttatcctgtgcctctcccatctcctgggtgggggcatcaaagcatttctccccttagg

SEQ ID NO: 12044 - DNA, 599 bp, Homo sapiens
  misc_feature 482, 586, 588: n = A,T,C or G
gacacatcattaaatatttaatcaccttttgaagtcctaagcctttatcataattcatccatctagacagttcattctatactatagattccaaggcccccttaagagggggagtaaaaagaaaattgggagagaaaaccctctgagaggcagggttaaattatctcaaagatgactttctattgatgctgtagtgaacttgcttcaccccgaaacccaccaatccacagtagggtcaaccgattaagtccactgctttttagtctccaagaatcagttttacaaaagatgccacatctgttcctttggattcatgtagggtgaaaaatggatgttgcattagctctgggtatgtaggccgttctttggaattcttctttaagcactgtgaggtaaagtcaacaaactctgcagagaacttgtctgctggaagttgtggcgatggctcctctaccacctgtttgagctgctgaatgggagtnccccatgaatcatagggaaatcgaaggatggccaactcaatcatcgtgatgcccagaactcaaatgtcagactcacactgtatccttctggttgagctctgggntnattctttcagg

SEQ ID NO: 12045 - DNA, 474 bp, Homo sapiens; identical to SEQ ID NO: 3593

SEQ ID NO: 12046 - DNA, 492 bp, Homo sapiens; identical to SEQ ID NO: 3595

SEQ ID NO: 12047 - DNA, 353 bp, Homo sapiens
gactgtcaatggagctggaaaacatcgtggccaacacggtcttgctgaaagccagggaagggggcggaggaaagcgcaaagggaaaagcaagaagtggaaagaaatcctgaagttccctcacattagccagtgtgaagacctccgaaggaccatagacagagattactgcagtttatgtgacaagcagccaatcgggaggctgcttttccggcagttctgtgaaaccaggcctgggctggagtgttacattcagttcctggactccgtggcagaatatgaagttactccagatgaaaaactgggagagaaagggaaggaaattatgaccaagtacctcaccccaaagtcccct

SEQ ID NO: 12048 - DNA, 797 bp, Homo sapiens
  misc_feature 675: n = A,T,C or G
tttggaggtgtaagtgaatttttattgggaggggaggttggcaacttaaacagcagcaaataaagagtgaataaggaaactccctgttgccacagatgcacaagacctccgtatgtgatacaggagccatttcaatttgtgacccctagacagagatggcaagtgcttttccattcaatctaatacttccggattcctactaaaaaggaatacattaagagcatggaaaagttgcttactgaaaggaaacccccgaagagtaagggagggaatgtagaaattaagaagttatgtggaatactctttaaattgtaattaactacattttcttattttcacagtaatacaaaacacagtcacttgcagaactggttcagattacttaaataccagatacatttttagtcctctacataagtgcttgggagttacttatgtttatatgaaatgaagctattaatacttttctacagcagtactgcacaccaggaaggccaagacaaacacaaatcaaggaatgaagttttcccaaagctgcagtgtgaaaagactataaacagttgattccatacacatgaatgggtttctttgctataggacatccaagtggaataaggattggagatgtgtaaaaaggtttcttgaacgaaagaaggatgacactctgtatggatntagttttcagccccttctgccgcatcacattcttctcctgcactgtctgatgtccaaagtggtagggttgtctcttagcaactgcatgatgagggtgctgtccttgcatgagatctcattca

SEQ ID NO: 12049 - DNA, 186 bp, Homo sapiens
ccaagattcggcacgaggggatcttttagcattggttctgtgtgtctgcctgctgcatacctttgcatctagggcagggccaggcacccaggggtgccgctgaggatccccaaagggaatggaagagggtcggtgtgctgcccggcacatgggcttgtctccccacagtggggagggcctggtcag

SEQ ID NO: 12050 - DNA, 164 bp, Homo sapiens; identical to SEQ ID NO: 2922

SEQ ID NO: 12051 - DNA, 599 bp, Homo sapiens
aagctcggaattcggctcgagtttttcattgcatagactgttaatatgtatataatacaagactatatgaattggataatgagtatcagttttttattcctgagatttagaacttgatctactccctgagccagggttacatcatcttgtcattttagaagtaaccactcttgtctctctggctgggcacggtggctcatgcctgtaatcccagcactttgggaggccgaggcgggccgattgcttgaggtcaagtgtttgagaccagcctggccaacatggcgaaaccccatctactaaaaatacaaaaattagccaggcatggtggtgggtgcctgtaatcccagctacctgggaggctgaggcaggagaatcgcttgaacccggggggcagaggttgcagtgagctgagtttgcgccactgcactctagcctgggggagaaagtgaaactccctctcaaaaaaaagaccactctcagtatctctgatttctgaagatgtacaaaaaaatatagcttcatatatctggaatgagcactgagccataaaaggttttcagcaagttgtaacttattttggcctaaaaatgaggtttttt

SEQ ID NO: 12052 - DNA, 424 bp, Homo sapiens; identical to SEQ ID NO: 3597
  misc_feature 347: n = A,T,C or G

SEQ ID NO: 12053 - DNA, 262 bp, Homo sapiens
  misc_feature 67, 77, 88, 90, 112: n = A,T,C or G
cttacctcaagtcgtgcatttatgatgctaaaacagatcccttctgccccatattccgtcttggcanaatagtgganaacgcaggccncngtttccaggacatggccgtggngggaggcatcatgggcatccaggtcaactgggactgcaacctggacagagccgcctccctctgcttgcccaggtactccttccgccgcctcgatacacgggacgttgagcacaacgtatctcctggctacaatttcaggtttgccaagta

SEQ ID NO: 12054 - DNA, 492 bp, Homo sapiens
tggtacgcctgcaggtaccggtccggaattcccgggtcgacccacgcgtccggttagactgggatccctgtctaccaagcttcactcccgtgcctaccagcaggctctcagcagggttaaagaagctaagcaaaaaagccaacagaccatttctcagctccattctactgttcacctgattgaatttgccaggaagaatgtgtatagtgccaatcagaaaattcaggatgctcaggataagctctacctctcatgggtagagtggaaaaggagcattggatatgatgatactgatgagtcccactgtgctgagcacattgagtcacgtactcttgcaattgcccgcaacctgactcagcagctccagaccacgtgccacaccctcctgtccaacatccaaggtgtaccacagaacatccaagatcaagccaagcacatgggggtgatggcaggcgacatctactcagtgttccgcaatgctgcctcctttaa

SEQ ID NO: 12055 - DNA, 116 bp, Homo sapiens
gggggccgcgcagcaacgcactggtgaccagactgtccccacgccgggaaccaagcaggagacgacaggcgagagaggagccagacagaccctgaaaagaaggacgggttggggcc

SEQ ID NO: 12056 - DNA, 429 bp, Homo sapiens
  misc_feature 80, 221: n = A,T,C or G
tggtacgcctgcaggtaccggtccggaattcccgggtcgacccacgcgtccgggtcagaagagttgtgcacgcagattancaggccaaggtctgagccacagcagcatttttatttcagattttgataactgtttatatgtgttgaaaaccaaaatgacatctttttaaagcttatccataaaaaaaaatagatgtcttttatagtggaaaaacacatggnggaaaaaaatcatctattttgatgcagcatttgataatgataaaacacctcacacctcactctttatagtgcacaaaatgaatgaggtctgggctaggtagaaaaagggtcaatgctatttttgtttttagaatcattaccttttaccagcttttaaccatctgatatctatagtagacacactatcatagttaacatagttaagttc

SEQ ID NO: 12057 - DNA, 484 bp, Homo sapiens
  misc_feature 408: n = A,T,C or G
tggtacgcctgcaggtaccggtccggaattcccgggtcgacccacgcgtccgtggacatcttcgagatcaatgaggcctttgcaagccaggctgcctactgtgtggagaagctacgactcccccctgagaaggtgaaccccctggggggtgcagtggccttagggcacccactgggctgcactggggcacgacaggtcatcacgctgctcaatgagctgaagcgccgtgggaagagggcatacggagtggtgtccatgtgcatcgggactggaatgggagccgctgccgtctttgaataccctgggaactgagtgaggtcccaggctggaggcgctacgcagacagtcctgctgctctagcagcaaggcagtaacaccacaaaagcaaaaccacatgggaaaactcancactggtggtggtggcagtggacagatcaaggcacttcaactcatttggaaaatgtgaacactgatgacatggtat

SEQ ID NO: 12058 - DNA, 518 bp, Homo sapiens
  misc_feature 463: n = A,T,C or G
tggtacgcctgcaggtaccggtccggaattcccgggtgctgattgtcgttctagccattggatttctcctggcgcctctacaaaagtccgtcctggcagctttagcattgggaaacttaaagggaatgctgatgcagtttgctgaaataggcagattgtggcgaaaggacaaatatgattgtttaatttggatcatgaccttcatcttcaccattgtcctgggactcgggttaggcctggcagctagtgtggcatttcaactgctaaccatcgtgttcaggacccaatttccaaaatgcagcacgctggctaatattggaagaaccaacatctataagaataaaaaagattattatgatatgtatgagccagaaggagtgaaaattttcagatgtccatctcctatctactttgcaaacattggtttctttaggcggaaacttatcgatgctgttggctttantccacttcgaattctacgcaagcgcaacaaagctttgaggaaaatccgaaaactg

SEQ ID NO: 12059 - DNA, 445 bp, Homo sapiens; identical to SEQ ID NO: 3600

SEQ ID NO: 12060 - DNA, 332 bp, Homo sapiens
  misc_feature 193, 205, 220, 252, 325: n = A,T,C or G
gatagtttacaggaactctctacagaacagaaatgctttgttgaacacatcctttgtacgaagccattgccctgcaggcagccagctccaattcgaggattttggattgtacctgacattctgggacccacgatgatctgcatcaccagtacctatgaatgcctcatatggccgttattaagtacagtccatncagcgtcttctnccctgctttgtactngagaagatgttgaagtggcagagtctcccctncgtgttctggctgaaaccccagattcctttgaaaagcatattaggaggcattttgcaacgtgttttgcccatncagcatt

SEQ ID NO: 12061 - DNA, 154 bp, Homo sapiens
ccccccccttaaaggggggggaaaacccccttccccttttaggggaaaaaaaaaaaaaagggggaaaaaatttttttttcccaaaccccttttttccgcccaacctttaattttttttaaacaaaaaagggagggttttctttaaccgcggggt

SEQ ID NO: 12062 - DNA, 410 bp, Homo sapiens; identical to SEQ ID NO: 235
  misc_feature 302, 303, 309: n = A,T,C or G

SEQ ID NO: 12063 - DNA, 538 bp, Homo sapiens; identical to SEQ ID NO: 2735

SEQ ID NO: 12064 - DNA, 652 bp, Homo sapiens; identical to SEQ ID NO: 3602

SEQ ID NO: 12065 - DNA, 413 bp, Homo sapiens
  misc_feature 1, 3, 6, 123, 206, 306, 356, 382, 394, 409: n = A,T,C or G
ngngcntggcagcgtggttctgggggtcggtttggccaggtccacaggtgcacagagaagtccacaggcctcccactggctgccaagatcatcaaagtgaagagcgccaaggaccgggagacngtgaagaacgagatcaacatcatgaaccagctcagccacgtgaacctgatccagctctatgacgccttcgagagcaagcacanctgcacccttgtcatggagtacgtggacgggggtgagctcttcgaccggatcacagatgagaagtaccacctgacttgagctggatgtggtcctgttcancaggcagatctgtgaaggtgtgcattacctgcaccaggactacatcctgnaacctgggacctccaagccggagaanatattgttcgtnatcagacaggacatnaaat

SEQ ID NO: 12066 - DNA, 501 bp, Homo sapiens; identical to SEQ ID NO: 234
  misc_feature 56, 431: n = A,T,C or G

SEQ ID NO: 12067 - DNA, 438 bp, Homo sapiens
  misc_feature 271: n = A,T,C or G
gaatgtcctaccttctttaccagatgctttgtggtattaaacatctgcattcagctggtataattcatagagatttgaagcctagcaacattgttgtgaaatcagactgcaccctgaagatccttgactttggcctggccggacagcgtgcactaacttcatgatgaccccttacgtggtgacacggtactaccgggcgcccgaaagtcatcctgggtatgggctacaaagagaaccgttgatatctggtcagtgggttgcatcatgggangagctggtgaaaggttgtgtgatattccaaggcactgaccatattgatcagtggaataaaagttattgaagcagctggggaacacccatcagcagagttcatgaagaaacttcagccaactgtgaggaattatgtcgaaaacagaccaaagtatcctggaatcaaat

SEQ ID NO: 12068 - DNA, 597 bp, Homo sapiens; identical to SEQ ID NO: 3603

SEQ ID NO: 12069 - DNA, 540 bp, Homo sapiens; identical to SEQ ID NO: 3604

SEQ ID NO: 12070 - DNA, 524 bp, Homo sapiens
aatttggccctcgaggccaagaattcggcacgagatttctgtgtgcagtggaactgtcaccgctgttcccagacacacttattctgggtctggagatccgggtgaaggtctcagactatgtacaagaccggattcgggccctacgcgcagctcctgcaggtggcttccagaacatcgcctgtctccgtagcaatgccatgaagcaccttcctaacttcttctacaagggccagctgacaaagatgttcttcctcttccccgacccacatttcaagcggacaaagcacaagtggcgaatcatcagtcccaccctgctagcagaatatgcctacgtgctaagagttggggggctggtgtataccataaccgatgtgctggagctacacgactggatgtgcactcatttcgaagagcacccactgtttgagcgtgtgcctctggaggacctgagtgaagaccccgttgtgggacatctaggcacctcaactgaggaggggaagaaagttctacgtaatggagggaag

SEQ ID NO: 12071 - DNA, 422 bp, Homo sapiens; identical to SEQ ID NO: 3605

SEQ ID NO: 12072 - DNA, 549 bp, Homo sapiens
tggtacgcctgcaggtaccggtccggaattcccgggtcgacccacgcgtccgcgctgtaaaaaagacagaggctgttccctatggcagaaggcaaccacagaaaaaagccacttaaggtgttggaatccctgggcaaagatttcctcactggtgttttggataacttggtggaacaaaatgtactgaactggaaggaagaggaaaaaaagaaatattacgatgctaaaactgaagacaaagttcgggtcatggcagactctatgcaagagaagcaacgtatggcaggacaaatgcttcttcaaaccttttttaacatagaccaaatatcccccaataaaaaagctcatccgaatatggaggctggaccacctgagtcaggagaatctacagatgccctcaagctttgtcctcatgaagaattcctgagactatgtaaagaaagagctgaagagatctatccaataaaggagagaaacaaccgcacacgcctggctctcatcatatgcaatacagagtttgaccatctgcctccgaggaatggagctgac

SEQ ID NO: 12073 - DNA, 172 bp, Homo sapiens
  misc_feature 54, 121: n = A,T,C or G
gcacgtagctaaacttaaggtcagaacagaaattcatgtgctgaacagaatggnttctttttgcagtaccaatccaattgattcctctttttattttcctgcgtccttaccagtcactttnatagtgctaactaacctacactatgggggttattcatgatttaagtatgat

SEQ ID NO: 12074 - DNA, 205 bp, Homo sapiens
  misc_feature 27, 29, 95: n = A,T,C or G
cagagctcagcacgacctcagccatgngnacttctcatcctggccctccttgggcatctcctctctcactgcatacattgtggaaggtgtagggngtgaagtctcacataggaggacctgtgtgagcctcactacccagcgactgccagttagcagaatcaagacctacaccatcacggaaggctccttgagagcagtaattttt

SEQ ID NO: 12075 - DNA, 82 bp, Homo sapiens
  misc_feature 18, 22, 24, 28, 75: n = A,T,C or G
atcatgccctgccttgtncctntnactncccagccccacccctaagtgcccaaagtggggagggacaagggattntgggaag

SEQ ID NO: 12076 - DNA, 66 bp, Homo sapiens
ggccgcccttttttttttttttttttttaaagggtcccccccttttaaaaaaatttttaaattttt

SEQ ID NO: 12077 - DNA, 486 bp, Homo sapiens
ttatagtggggattttattttaagtttgttggttaggtagttgaggtctagggctgttagaagtcctaggaaagtgacagcgagggctgtgagttttaggtagagggggattgtcgtttggaagggggatgcgggggaaatgttgttagtaatgagaaatcctgcgaataggcttccggctgccaggcgtttaatggggtttagtagggtggggttattttcgttaatgttagtaagggtggggaagcgaggttgacctgttagggtgagaagaattattcgagtgctataggcgcttgtcagggaggtagcgatgagagtaatagatagggctcaggcgtttgtgtatgataatgttgcggtttcgatgatgtggttcttggagtagaaacctgtgaagaaaagtaatcctgccaatgccaagctgccaattgttaaggaagtttaaattagaagtattgttttgaatagtcctccctcgtgccg

SEQ ID NO: 12078 - DNA, 438 bp, Homo sapiens; identical to SEQ ID NO: 3606

SEQ ID NO: 12079 - DNA, 506 bp, Homo sapiens
cggcagtgtaggagcgcgtgcccacgaaggagttggccatggagtctatgagctggccgctcaccccgaagtcacacagcttgatctcccctctagagttcacgaggatgttggagggcttcacatctcggtgcatgatctggtgcttctctcggaggtacgccaagccccggagaaccgcgatgctgactttccccaggatctcctcgggaatcctcttggcctctttcagcacctggtccagggagccgccgtccatgtgttccatgcaaatgctgatctccccgtcactgtagaaggccccgtagaagcccacgatgtacggcgagttgcattcgtgcaggacctgcagctcgcggatgatctggttccggatggccggcttgatctcaaggtggatcagcttcctggccatgatgaggccgaggttctgtgctggactttggtgacaccccgccgttgccgtgccagctctgagatccttcgaagtatcgtctttgattcgc

SEQ ID NO: 12080 - DNA, 542 bp, Homo sapiens
caaaaagaaagccccagcgctctagagctcagctgacgggaaagggggtgcgcagcctcgagtttgagagctacccggagctccaagacaggggccggaccatgggaaccccaaagccacggatcctgccctggctggtgtcgcagctggacctggggcaactggagggcgtggcctgggtgaacaagagccgcacgcgcttccgcatcccttggaagcacggcctacggcaggatgcacagcaggaggatttcggaatcttccaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatg

SEQ ID NO: 12081 - DNA, 132 bp, Homo sapiens
cccccatttttattaccaacccactttttttcaaagaaaacctaggcggccttttcccccaagattttcccaaggttttaaaatttttttcaaataccgtgccttccaaatccccttccccaattttccccc

SEQ ID NO: 12082 - DNA, 711 bp, Homo sapiens; identical to SEQ ID NO: 3610
  misc_feature 494: n = A,T,C or G

SEQ ID NO: 12083 - DNA, 448 bp, Homo sapiens
gcagccgtggctgagtccagaactactgagacaggatttacatgggtataatgtgaagtcagatatttacagtgttgggattacagcatgtgaattagccagtgggcttttttctttccagggggtgcatagaactcagatgctgttacagaaactgaaaggtcctccttatagcccattggatatcactattttccctcaatcagaatccagaatgaaaaattcccagtcaggtgtagactctgggattggagaaagtgtgcttgtctccagtggaactcacacagttaatagtgaccgattacacacaccatcctcaaaaactttctctcctgccttctttaacttggtacagctctgtttgcaacaagatcctgagaaaaggccatcagcaagcaccttattgtcccatgttttcttcaaacagatgaaagaaaaaagccaggat

SEQ ID NO: 12084 - DNA, 510 bp, Homo sapiens
ctatagggaatttggccctcgaggccaagaattcggcacgagggctaaagagagagttcgtcaggatccttgtgaggatatttctcgtatccagaaaatcagatcaagggaagtagccttggaagcacaaacttcacgttacttaaatgaatttgaagaacttgccatcttaggaaaaggtggatacggaagagtatacaaggtcaggaataaattagatggtcagtattatgcaataaaaaaaatcctgattaagggtgcaactaaaacagtttgcatgaaggtcctacgggaagtgaaggtgctggcaggtcttcagcaccccaatattgttggctatcacaccgcgtggatagaacatgttcatgtgattcagccacgagacagagctgccattgagttgccatctctggaagtgctctccgaccaggaagaggacagagagcaatggtggtgttaaaaatgatgaaagtagcagctcatccattatctttgctgagcccaccccag

SEQ ID NO: 12085 - DNA, 183 bp, Homo sapiens
ataagcagatcacatccagaacaaccccacccgacagaaatgacagctacttcctagagactttaggtgctacagagcagattcatgcgcttaataagaattgagcctcattatcacctaagaaagctgaggaagcatatattaccaagtgcaattaacaagagagtttttattcctataaaa

SEQ ID NO: 12086 - DNA, 68 bp, Homo sapiens
cggccgccctcttttttttttttttttttttctatatttttttatgttttttttttttttcttttttt

SEQ ID NO: 12087 - DNA, 250 bp, Homo sapiens
  misc_feature 89: n = A,T,C or G
ctcaggtgcaaccccctgcgtggtcctctgtggcagccttctctcattcagagctaaaaagaaaactcagtagaagataatggcaagtncagactggggatatgatgacaaaaatggtcctgaacaatggagcaagctgtatcccattgccaatggaaataaccagtcccctgttgatattaaaaccagtgaaaccaaacatgacacctctctgaaacctattagtgtctcctacaacccagccacagcc

SEQ ID NO: 12088 - DNA, 270 bp, Homo sapiens
  misc_feature 26, 41, 242, 262: n = A,T,C or G
gggatattgcagggcaggagcgcttnacctctatgacacgnttgtattatcgggatgcctctgcctgtgttattatgtttgacgttaccaatgccactaccttcagcaacagccagaggtggaaacaggacctagacagcaagctcacactacccaatggagagccggtgccctgcctgctcttggccaacaagtgtgatctgttcccttgggcagtgagccgggaccagattgaccggttnagtaaagagaacggttttanaaggttgg

SEQ ID NO: 12089 - DNA, 238 bp, Homo sapiens
  misc_feature 127, 128, 129, 130, 131, 132, 133, 134, 135, 136, 137, 138,139, 140, 141, 142, 143, 144, 145, 146: n = A,T,C or G
ggttaatgattttttgttcattctgatttgtcattttattatctgttatcggtctaaagtgctaatttacccatttgatttttctgctagacagataacttttaatttttcaaatttggcagacacnnnnnnnnnnnnnnnnnnnntctttccttccagatctgttgcccactgaacagccacccgtccctcactgtcctggtgtccgattgggctggatggtgttggggcatgatgt

SEQ ID NO: 12090 - DNA, 409 bp, Homo sapiens; identical to SEQ ID NO: 3613
  misc_feature 322: n = A,T,C or G

SEQ ID NO: 12091 - DNA, 226 bp, Homo sapiens
  misc_feature 188: n = A,T,C or G
gcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcanggaccttctggatattttacgggaaagaggtaagctgt

SEQ ID NO: 12092 - DNA, 247 bp, Homo sapiens
  misc_feature 23, 60, 108, 126, 163, 215: n = A,T,C or G
acagcagctacacagttccaggntacatgcaggacttggaggtggagcaggccctgactncaggggatattgggctgagtctacagcgtgtcttcacagatctgaagnacatggatgccacctggntggacagctgctgaccccagttcggttgcccttcatncagggcatttcctgtgcaacgtagcaggggccctggggcccttttatttctntaggcaagcaggacctgggattatggtggata

SEQ ID NO: 12093 - DNA, 260 bp, Homo sapiens; identical to SEQ ID NO: 826

SEQ ID NO: 12094 - DNA, 181 bp, Homo sapiens
agctgagcatgcaaatgattccctagcacccattactttaaataccattactgcagccacacgccttggaggtgaagtgtcctgcttagtagctggaaccaaatgtgacaagaaccttttgcccagagtagcagccaaacttgaggttgccccgatttctgacatcattgcaatcaagtca

SEQ ID NO: 12095 - DNA, 446 bp, Homo sapiens
ccaagaattcggcacgagtgacgtcctgcacagcgacaagaagctgactttggtttttgaattctgtgaccaggacctgaagaagtattttgacagttgcaatggtgacctcgatcctgagattgtaaagtcattcctcttccagctactaaaagggctgggattctgtcatagccgcaatgtgctacacagggacctgaagccccagaacctgctaataaacaggaatggggagctgaaattggctgattttggcctggctcgagcctttgggattcccgtccgctgttactcagctgaggtggtcacactgtggtaccgcccaccggatgtcctctttggggccaagctgtactccacgtccatcgacatgtggtcagccggctgcatctttgcagagctggccaatgctgggcggcctctttttcccggcaatgatgtcgatg

SEQ ID NO: 12096 - DNA, 563 bp, Homo sapiens; identical to SEQ ID NO: 3616
  misc_feature 2, 529, 554: n = A,T,C or G

SEQ ID NO: 12097 - DNA, 439 bp, Homo sapiens
tggatcccccgggctgcaggaattcggcacgagcacaaaccaagaaaaggtggtgattgtgagccatcttcccatttacccggacgcctctgacaatgtgtgcctggcctggaactacagagatgccctggcagtcatttggtctcatgagtgtgtggtgtgtttctttgctggtcacacccatgatggtggctactctgaggatccttttggtgtataccacgtcaacctagaaggagttattgaaacagctccagacagccaagcctttggcacagttcatgtctatcctgacaaaatgatgttgaaagggagaggcagagttccagatagaattatgaattacaagaaaggaagagccttccattgttagtctaatttattttaacttgataaaaaatgagctttgtgtttgtccctcctaaacaaaaaaataaaa

SEQ ID NO: 12098 - DNA, 629 bp, Homo sapiens
tggtacgcctgcaggtaccggtccggaattcccgggtcgacccacgcgtccggggactgcggcgcttgcacgtcaacgggaggtgtgagcccaaaggtctggacccagaaatgggacgtcggtcatcagatactgaagaagaaagcagaagcaagagaaaaaagaaacaccgtagacggtcctcctcgagcagttcttcagatagtagaacatacagccgaaagaaaggaggaaggaaatcaagatcaaagtcaagatcttggtccagagatcttcagcctcgttcacattcttatgatagaagacgcaggcatcgatcaagcagtagctcttcttatggctccagaaggaaacgaagtcgaagtcgttcaaggggtcgagggaaatcctatagagttcagaggtctaggtcaaaaagcagaacaagaaggtccaggtcaagacctcgtctccgttctcatagtcgtagcagtgaaaggtccagtcacagaagaacgcgtagtcggtctcgggatagagaacgacgtaagggcagagataaagagaaaagagaaaaggagaaggataaagggaagggacaggaattacataacatcaaacgtggggaatctggaaacatcaaagctgga

SEQ ID NO: 12099 - DNA, 242 bp, Homo sapiens
gtgtggtctggctataaatttagactgttgcttgaaagaagcgaaaaacctccccttcatagacttccttcttcccatcccccctggcagccgctttgttcctctagccttgtaaaattttctctgtataaaacaggaacatcagccaaacatgtggacttccccactttccattcattagaagaatgcattatttcaaaatctcctgggagcatttaaatgcaaattttgtcaagaaagca

SEQ ID NO: 12100 - DNA, 268 bp, Homo sapiens
  misc_feature 194, 205, 221, 222, 223, 229, 234, 245, 260, 261, 265: n = A,T,C or G
gtctggacatgtttgagcacatcagcctcatgaccttggacagtctacagaaatgcatcttcagctttgacagccattgtcaggagaggcccagtgaatatattgccaccatcttggagctcagtgcccttgtagagaaaagaagccagcatatcctccagcacatggactttctgtattacctctcccatgangggcggcgctnccacagggcctgccgnnntggtgnatganttcgcagacgntgtcatccggggagnnggcngtc

SEQ ID NO: 12101 - DNA, 201 bp, Homo sapiens
acaagatggcggcggcagctgtacagggcgggagaagcggtggtagcggaggctgtagtggggctggtggtgcttccaactgcgggacaggaagtggccgtagcggcttgttggataagtggaagatagatgataagcctgtaaaaattgacaagtgggatggatcagctgtgaaaaactctttggatgattctgccaaaa

SEQ ID NO: 12102 - DNA, 350 bp, Homo sapiens; identical to SEQ ID NO: 828
  misc_feature 62, 73, 130, 306, 313, 322: n = A,T,C or G

SEQ ID NO: 12103 - DNA, 404 bp, Homo sapiens
  misc_feature 113, 168, 229, 239, 319, 344, 368, 395: n = A,T,C or G
ggaaataagtcaaagcattgtttatttatgacatatttacatatttacaaaactgattttactcaatacatcatcctgcgtaatatcataaaatgaacaccatatcctgggantaaaaatccatatttcttaataatttatgtatagcccaacttttagaacatagantattatcaatttggcttcccaaactacaaagtcctgtttataattttttctagccaaggancagagtaggntcaacaggcatattaaagtaatttagttaaccctgaggtaattactaacttggcataattttggaatggggtatatatancacactttccatctggcacttaggntacttattactattcacactaccnttttggtatttatccacctcaattttncaacttcct

SEQ ID NO: 12104 - DNA, 506 bp, Homo sapiens
  misc_feature 315, 378, 397, 404, 412, 417, 426, 437, 443, 451, 463, 500: n = A,T,C or G
acaaaggacatttcatttttaatcactcaaaaatgaaaaaggtttggacaatgtcaaattccactcaccataatgctatagttatacattaaatataattactatctatacatatgcaaaaatataaagttctatttcatacaataaaaccctttatagaaaccattttaaaattaagcagaacttctcaacattaatatgtgaggtctaagtccttctaaaggtttctttaaaggtttttaaacaaaatgctaaacctaaaaacattgtcctgtcagttcccaaattaaatctacttaggaacaaaaacaaaantttataggctcgggtcacatactacttaaataatattgttcagggcatctctaaaatcctccntggttttcaagtatggggnatagggnctcaaatnttccncattacagnactaaacggtnggggtntttggggnaggctttggtgncctatgggcccctttttattatttggtggcttcatanggttgg

SEQ ID NO: 12105 - DNA, 470 bp, Homo sapiens
gacatttggaagagtcagtgacttggggcaattcatccgagaatctgagcctgaacctgatgtaaggaaatcaaaaggatccatgttctcacaagctatgaagaaatgggtgcaaggaaatactgatgaggcccaggaagagctagcttggaagattgctaaaatgatagtcagtgacattatgcagcaggctcagtatgatcaaccgttagagaaatctacaaagttatgactcaaaacttgagataaaggaaatctgcttgtgaaaaataagagaacttttttcccttggttggattcttcaacacagccaatgaaaacagcactatatttctgatctgtcactgttgtttccagggagagaatggggagacaatcctaggacttccaccctaatgcagttacctgtagggcataattggatggcacatgatgtttcacacagtgaggagtctttaaaggttaccaaa

SEQ ID NO: 12106 - DNA, 242 bp, Homo sapiens
  misc_feature 8, 16, 26, 48, 50, 61, 67, 73, 78, 85, 101, 111, 114, 115,117, 118, 130, 135, 154, 159, 163, 171, 175, 184, 191, 209,221, 231, 232: n = A,T,C or G
aaggagcntaaagatnataatattgngaagatgatggatgttatttananagaaaataaantctacntggctnttgantttgtgnaccacgatctgaaganattgatgganganntnngctgttactggnattantattactctgatgaagagntatcngttntagctgtntganggtgtagcnttatgcnattttaatcgggtgctcnaacgagaggttnaagctgagannttgcttatta

SEQ ID NO: 12107 - DNA, 555 bp, Homo sapiens
aaaaggggtaaacagtgataccatttactgaattggagttactattaaaattcaaaaactgaacatattcatttaaccacaagccagtcttagttttaaatcaggactgcccaacaaaatattctgtcagtcattcatgatctgaattctggtgtatgagatctattaaaggatggtacacataaaaaagtcatgagacatttctgttttgtaataaataaggcagtggccaattattactcattagtagcttttttgagataagctattaagtctgccctttcttccttcttcttaatgccgacaaagatcatttttgttccagggatgtacttcttgggattctccaaatactccatcagtgtatcctctccccagatgatgcctttgttcttattggcggctgtgtaagagtatccaggggcctgacctgtcttccgcccaaagagaccatggagatttggcccagtcttgtgcttgcctcccttttcaacggtgtggcactgggaacactccattataaaaattcttcttgcctttctcaacatcacccat

SEQ ID NO: 12108 - DNA, 461 bp, Homo sapiens
tggtacgcctgcaggtaccggtccggaattcccgggtcgacccacgcgtccgaattaagaggaaaatagaagttgcttttaggggtttctgacatatattctggatactatccgaggtaattttgaagtttaatataaatgctcatatcaaatgaatatagaactaatattgtcgggaacacctaatagaaaggaatactattatagcaaatcacagaatgatagactcaagcataaaacttggcagttttatctgcttcaaaatgccattgatcattattcctgtattttctctgaaactgattataaaaaccaatgtccagctactcttttgtttttgacacttgaagaaatggagatcgatttgatttgtttataagcagacacactgcaatttacaaagatctctttacggttttataaaattatcttccagtttgtacatttatatggaattgttc

SEQ ID NO: 12109 - DNA, 97 bp, Homo sapiens
  misc_feature 95: n = A,T,C or G
gaattctaaaaaatatttttttctatgaaattactagtgcccagctgtagaatctaccttaggtagatgatccctagacatacgttggttttgangg

SEQ ID NO: 12110 - DNA, 514 bp, Homo sapiens
  misc_feature 239, 369: n = A,T,C or G
tggtacgcctgcaggtaccggtccggaattcccgggtcgacccacgcgtccgaggacttggaggccctgatgtttgatcgctcctttgtggggaagcagttctcagcaaatgacaaagtttacactgtggagaaggccgataactttgaatacagcgacccagtggatggaagcatttcaagaaatcagggcttgcgcctcattttcacagatggttctcgaatcgtcttccgactgancggcactgggagtgccggggccaccattcggctgtacatcgatagctatgagaaggacgttgccaagattaaccaggacccccaggtcatgttggccccccttatttccattgctctgaaagtgtcccanctgcaggagaggacgggacgcactgcacccactgtcatcacctaagaagacaggcctgatgtggtacgtccctccacccccggacccatccaagtcatctgattgaagagcatgacagaaacaaaatgtattcaccaagcatttt

SEQ ID NO: 12111 - DNA, 160 bp, Homo sapiens
gccgccctttttttttttttttttttttttttttttttttttttttttttttttttttcttttttttttttttttttttttttaaaaaaaaaaaggtgtttttttcccccccccccaaaaaaaaaaaaaaaaaggggggcgggggggggggggttttttt

SEQ ID NO: 12112 - DNA, 221 bp, Homo sapiens; identical to SEQ ID NO: 47

SEQ ID NO: 12113 - DNA, 238 bp, Homo sapiens
ctcaattccaaggcattggaaaaagagaggaacaagcagaagatgcctgcaggtatcactttgatcctatgtgggagcgactgaaaatagaatgagcttggttaagcacctctcctttgcccttcaccctgactcctgtcactgtctccatccccaaataaagctgaaatatttttttaagttagctgccgagaaaacattttgcatgaaggataaagttctgttaaaatacatcctt

SEQ ID NO: 12114 - DNA, 353 bp, Homo sapiens
tggtacgcctgcaggtaccggtccggaattcccgggtcgacccacgcgtccgataaattcatgattagaagaattatactgtttttcttgcgcaaataatacttaatgcagatgttcactctcacagtgatgttggaaagcatattttatgcaggctaaacactatttctgtattagatatttaaatgcgtgaggataaattctaattgctttttgttctaaaacagaaacatagaagaagcattatccccagcttgtataaaatgtctgctgcaactgaattcatgatagttcatgaaaactgaaaatcattccaattttgtaaaactgctgctactggttttatcaataaa

SEQ ID NO: 12115 - DNA, 290 bp, Homo sapiens
  misc_feature 236, 265, 269: n = A,T,C or G
gaacaatgatggtgcacaaaggcttagatttgccttgtctcaaaataaggaattttgtagtggttttcaaaaataattcaacaaagaaacaatacaaaaagtgggtagaattacctatcacatttcccaatcttgactattcagaatgctgtttatttagtgatgaggattagcacttgattgaagattcttttaaaatactatccagttaaacatttaatatgattatgattaangaatccattaggctacagacctgacaatngagnctcaataaaatgattgtttta

SEQ ID NO: 12116 - DNA, 247 bp, Homo sapiens; identical to SEQ ID NO: 120
  misc_feature 178, 207, 212, 246: n = A,T,C or G

SEQ ID NO: 12117 - DNA, 98 bp, Homo sapiens
actttatcacatctccacatgtacaatacagggaaccagttgcattgtgtgccaatggatgaagttttttttgtttgtttgtttttgttttttttgag

SEQ ID NO: 12118 - DNA, 262 bp, Homo sapiens
caaggggatgatttgccgacatgtttgagaaccccctaacctctaaccctcattgctgtcttgccccagtttggggtgccaagatggaagtcacctttctgggctttctcctggagatagctggggcttatgggtggctttcaaggctggggcatggcaaatcaggggccagagagcaggggagcttgggactcaggtctgtaactgcccagccccttttctctgctcttgtttcactccaccatcactcactcactcccca

SEQ ID NO: 12119 - DNA, 343 bp, Homo sapiens
ggccgcccttttttttttttttttttttttttttttttttgggtttttttttgttttaacaacgggggccaaaatttattttccctagggggccaattttggttgcgcggaaaaaccctttggggaaaggcaaaaatatttgggggggggggggaaaaaaaaaattgggcccccaaattttgggggggttttttttttaggggccgttttttcccccctgggggggaaaccgcccccaacccccgggtttttttttttttaaaaaaaaaacccaaacccccggtttttttttaaacttccccaaatttggaaaaaattttgggggggaaaaaaaaaaggggcc

SEQ ID NO: 12120 - DNA, 579 bp, Homo sapiens
ccaagaattcggcacgaggatgtgacatttagatacattgcaatcatgacaaatatttggatttcaaaatgacgtgtgagccatttatatttttgttgtgctttgttatcttatgggctcccataagataacaaggcttcaacactatggcttgaaaatgttttgatctgaaaggtatattagggaacacacagcataatcctaccactttgcttctgtctggtgaaatgtcaattgtttcctctctctgagcaccagctgtccaaatggcatgggaaggggcagtggaggggaagagaatgaaaatgagggaggttctaagaaggtggcaaggaattgggatgcaaaatcctgtgactgcctctcacagatttctggaatcttgttattatgtcagcttttgttttatccactgttattggtagtaagtggaacacactgggtaaatacgtcccaagttattcctttacactatacagtttttttcagggctgtcccaccacccccaatcccatttgaaatcaaatatagatgttatttaagcataaaagagtcaggaagccctatgctccccatctg

SEQ ID NO: 12121 - DNA, 340 bp, Homo sapiens
  misc_feature 9, 63, 334: n = A,T,C or G
aactgagtnatttaaagtatgaaactacagtgttagcagagatgtgaagcacaggcacgctanacattactgtgggagtttcatgaagccacttgattttttataatctcctaaacaatcatattacattgtattcaacttagtagcatgattccttacttttctggttttaagtctctataaattattcccagggctatgtagatggtctaaagcaagtgcaagttcagccaagtaggaatttgacatcttcttctgtgaaccatcaccctaaaataaaccaataatttttcctaaatttattttctttttgtggccggtaatttttaaggtncccctc

SEQ ID NO: 12122 - DNA, 607 bp, Homo sapiens; identical to SEQ ID NO: 3622

SEQ ID NO: 12123 - DNA, 584 bp, Homo sapiens
ccaagaattcggaacgaggggtcatgaaaaaaaattgagaaacattacctcatacacaatgaatgaatcagaggacagacacgggaatggcacgactgtgcagtgtgttactaggaaaaaagttcagaatcactgttctagagagcttcatttccattggttttaaaacattattctcatgtagaacagtgttcgggtctcatactgttaatgttaatacgtaacaatgttcatgttaacaggcacctgttaatattaacagataatgttactgttaacaggtaagagaaattgctctaagtgcccaaactttatatacttcagttttaatgacaagcatttcagaaatataagagcggcagccacaccaaccagtttttccagatatcttgatgtgaacctgaccctactcctttagaagacagcctgttcatttttaaatagctttaacccaaactgttctatgaccattgtttcaagagacattaacacagttctgtaaatagaagtgtctatggacaaataagtctgggaaatgtggcatactgtatccttttcttaacatttgcatattaaagactctg

SEQ ID NO: 12124 - DNA, 529 bp, Homo sapiens
tcactatagggcgaattgggtaccgggcccccccggagtgcaaaggaggcgacctgcaacagaggagtcccggtcaccagcaaccatgacggaccagcaggctgaggccaggtcctacctcagcgaagagatgatcgctgagttcaaggctgcctttgacatgtttgatgctgatggtggtggggacatcagcgtcaaggagttgggcacggtgatgaggatgctgggccagacacccaccaaggaggagctggacgccatcatcgaggaggtggatgaggacggcagcggcaccatcgacttcgaggagttcttggtcatgatggtgcgccagatgaaagaggacgcgaaagggaagagcgaggaggagctggccgagtgcttccgcatcttcgacaggaatgcagacggctacatcgacccggaggagctggctgagattttcagggcctccggggagcacgtgacggacgaggagatcgaatctctgatgaaagacggcgacaagaacaacgacggccgcattgac

SEQ ID NO: 12125 - DNA, 548 bp, Homo sapiens; identical to SEQ ID NO: 841
  misc_feature 231: n = A,T,C or G

SEQ ID NO: 12126 - DNA, 463 bp, Homo sapiens
  misc_feature 15, 176, 180, 259, 304, 404: n = A,T,C or G
ggactcgcaggtgtncggcgacgagggctggtggaccgggcagctgaaccagcgggtgggcatcttccccagcaactacgtgaccccgcgcagccttctccagccgctgccagcccggcggcgaggaccccagttgctacccgcccattcagttgttagaaattgattttgcggantcancttggaagagattattggcatcgggggctttgggaaggtctatcgtgcttttggataggggatgaggttgctgtgaaanagctcgccacgaccctgatgaggacatcagccagaccatagagantgttcgcaagaggccaagtcttcgcatgtgaagcaccccaacatattgcctaagaggggtattctgaagagcccaactctgttggtcatggagtttgtgntgagaacctttgaatagagtgtattggaaaagattccccagcatctggtgaatgggcgt

SEQ ID NO: 12127 - DNA, 484 bp, Homo sapiens
tgagttctaaagttcctgttgcttcagacaatggatgagcaatcacaaggaatgcaagggccacctgttcctcagttccaaccacagaaggccttacgaccggatatgggctataatacattagccaactttcgaatagaaaagaaaattggtcgcggacaatttagtgaagtttatagagcagcctgtctcattggatggagtaccagtagctttaaaaaaagtgcagatatttgatttaatggatgccaaagcacgtgctgattgcatcaaagaaatagatcttcttaagcaactcaaccatccaaatgtaataaaatattatgcatcattcattgaagataatgaactaaacatagttttggaactagcagatgctggcgacctatccagaatgatcaagcattttaagaagcaaaagaggctaattcctgaaagaactgttttggaagtattttgttcagctttgcagtgcattggaaca

SEQ ID NO: 12128 - DNA, 443 bp, Homo sapiens; identical to SEQ ID NO: 843
  misc_feature 215: n = A,T,C or G

SEQ ID NO: 12129 - DNA, 174 bp, Homo sapiens
tggtacgcctgcaggtaccggtccggaattcccgggtcgacccacgcgtccggtcccagctactcatcggggctaggcaggaggattgcttgagcccagaggtcgaggctgcagtgagccatgatcacaccactgctgcactctagcctgagtgagagagcaagaccctgtctc

SEQ ID NO: 12130 - DNA, 129 bp, Homo sapiens
tatttatttccacataaggaaacagattgagaggctaaataccctgcccaatacatacaactgtaagtggagaagctgtattccaacccatattctcctcaatatccctgtagggacaagcaactctga

SEQ ID NO: 12131 - DNA, 522 bp, Homo sapiens; identical to SEQ ID NO: 3626

SEQ ID NO: 12132 - DNA, 497 bp, Homo sapiens
gaagctggtacgcctgcaggtaccggtccggaattcccgggtcgacccacgcgtccgagaaaacacatgaaaccctgagtcacgcagggcaaaaggcaactgcagctttcagcaacgttggaacggccatcagcaagaagttcggagacatgagttactccattcgccattccataagtatgcctgctatgaggaattctcctactttcaaatcatttgaggagagggttgagacaactgtcacaagcctcaagacgaaagtaggcggtacgaaccctaatggaggcagttttgaggaggtcctcagctccacggcccatgccagtgcccagagcttggcaggaggctcccggcggaccaaggaggaggagctgcagtgctaagtccagccagcgtgcagctgcatccagaaaccggccactacccagcccatctctgcctgtgcttatccagataagaagaccaaaatcccgctgggaaaaacccaggccttgaca

SEQ ID NO: 12133 - DNA, 510 bp, Homo sapiens
tggtacgcctgcaggtaccggtccggaattcccgggtcgacccacgcgtccgcggacgcgtgggcggacgcgtgggtgggaatgaccctgccaatggcgagccaagccgggctgtgctggatgccctgctggagggcaaggcccagtggggggagaatcttcaggtgactctgatccctactcatgacacggaggtgactcgtgagtggtaccaacaaactcatgagcagcagcaacaactgaatgtcctggtcctggctagcagcagcaccgtggtgatgcaggatgagtccttccctgcctgcaagattgagttctgaaagagccgccctcccttccccaaggatccactcccccagctcctttagagaatggctactgctgagtcctttggggttgagggagatgggagctagggggaggggagggagatgtcttgttgtggggacttgggctgggctaaatgggaggggttgtccctccccatcatccattcctgtgaggtgtctc

SEQ ID NO: 12134 - DNA, 258 bp, Homo sapiens
  misc_feature 22, 101, 213: n = A,T,C or G
gtgtccgcagcttctgcctggnacgccgccgcctataagctaccaggaggagctttacgacttcccgtcctgcgggaagtggccgggcacgatcgcaaggnagcgcagaagcttctcaatggccagcgccagctgcagccccggcggcgcactcgcctcacctgagcctgggaggaaaattcttccaaggatgatctcccactcagagctgangaagcttttctactcagcagatgctgtgtgttttgatgttgacag

SEQ ID NO: 12135 - DNA, 277 bp, Homo sapiens
ggccgcccttttttttttttttcccccctaaaaaaaaacgggggtttttttttttcaaaaacaagggggaggggttttattaaaaaaaaggagggatttttttaaaaaaaaggggggcccttttttgcgggaaaaaaggggtttcccaagacccaaaaaaattgatcccccccccagaaactttttgaaaattaagggggttttttaaacgggttagaattttttttgcccttgccccttttggggaccctaaaccaaaatttttttaagtttttca

SEQ ID NO: 12136 - DNA, 268 bp, Homo sapiens
ggccgccctttttttttttttttccccccccaaaaatttttaaaaagcccttttttttaaaaaacctttttttaaaaagggaatttttaaaaaatttaaaaaattttttttaaaaaaaattgcccctgggctttttttaagggccctttttttttaaaaaaaaaacccttttttttaaaaaacccaaaaatcccccaagggggttttcctggggttaaaaaagggccaaaaaatttttggtttggccttttctttaaaaaaaaagggg

SEQ ID NO: 12137 - DNA, 258 bp, Homo sapiens
  misc_feature 35, 86, 123, 139, 153, 154, 155, 156, 157, 158, 159, 160,161, 162, 163, 164, 165, 166, 167, 168, 169, 170, 171, 172,173, 217, 241, 257: n = A,T,C or G
ctgagctccttaaccattccatatgaagaggatgnggaggaagaagaaaaagaagagacatatgatgatattgatggttttgactncccaagttgtggttcccagtgcagacccactatcttncctgggagtgtggggntaaaagagcctacnnnnnnnnnnnnnnnnnnnnntatttatgaagtcttaccagatgaagagcatgatctagagaggntgagagtggcactcgacgaaaagngtagactataccattnt

SEQ ID NO: 12138 - DNA, 248 bp, Homo sapiens
  misc_feature 2, 19, 42, 126, 129, 147, 157, 183, 198, 228, 246: n = A,T,C or G
cnacgatggcctgctgggngacaatcagatcatgcccaaganaggcttcctgataatcatcctggccataatcgcaaaagagggcgactgtgcccctgaggagaaaatctgggaggagctgagtgngtnagaggtgtttgagggganggaagacagnatcttcggggatcccaagaagctgcncacccaatatttcgngcaggaaaactacctggagtaccggcaggnccccggcagtgatcctgnat

SEQ ID NO: 12139 - DNA, 648 bp, Homo sapiens; identical to SEQ ID NO: 3627

SEQ ID NO: 12140 - DNA, 526 bp, Homo sapiens
gagagaccacattcacataacttttattacaatattcattattgttaatctcttaccgtgccttataaattaggctttatcacaggtatgtgtgtaaaggaaaaagcatggaatatatcgggtttggcactatcccgggtttcagatatccactgggggtcttggaacatattccccatggattactgtgggatcctgtgcttgaaaattacgtatttattatcttcagtataatgtgttatgggggtagaaacttcattgttgtgttcaccaatgtatctcaagctggtacacagtattcaacaaatatctgctgaatgaatgaaacgtattgctttattatttggttgttcctcttatcaatattagttatcttctagaatgtggttttgctttcagttctactttgatattaatactgtcaccatcattttttgttcatgaaggcttgtctacttttgcctgtatcttaatttttactctcagtttgtgtttctctattccaagcagcaaatgttgcatatat

SEQ ID NO: 12141 - DNA, 572 bp, Homo sapiens
  misc_feature 492: n = A,T,C or G
tggacagcttaccggtctgcaagactccctggggggcagtgctgactatggagcgggaggggggcggcgcggccttgttgccactccgtgcttcggcagccaggcgcctgatgtaagcgtcccccacacacagcaagatgttctcgggcttgatgtccgtgtggatgatcttgcacttggtgtggaggtagtccaggccgtgcagcacctgcctcacgatgctcttcacgcagggcacgggcaggccctggtagttggacttgatgatccatttgaggagctggtggcccagcacctccagcaccatgcacacatggactccattgactcctgagatcctgaagtcatcaatgagctggacaatggtctctcttttggggtcactggggtcgctgtcccggacacatttcaggagcttgatctcatccacagctgtctccgtgtaatgccccgaactcttcaccactttgagggccacaaagcgcttctcgnattgtcccagcagagccagacggtggagaagtggccccagccagtttgcgcaccacgtggtacccgccaatgaacacgtc

SEQ ID NO: 12142 - DNA, 622 bp, Homo sapiens
caacacatgaacctctggctagaggacatattcacagatagaacataactgtaacatatatgaaaggcttctgggacttgaaatcaaatgtttgggaatggtgcccttggaggcaacctcccattttagatgtttaaaggaccctatatgtggcattcctttctttaaactataggtaattaaggcagctgaacagtaaattgccttctagacactgaaggcaaatctcctttgtccatttacctggaaaccagaatgattttgacatacaggagagctgcagttgtgaaagcaccatcatcatagaggatgatgtaattaaaaaatggtcagtgtgcaaagaaaagaactgcttgcatttctttatttctgtctcataattgtcaaaaaccagaattaggtcaagttcatagtttctgtaattggcttttgaatcaagaatagggagacaatcaaagaatatcttaggttggagatgacagcaatatgattgatttgaagtggaaaaagaaattcaggtaatgttaattaaagtaagattaatcgctgaatggttgaaaatgtcacctagcagataaggatactatctggcatggtaatatggcgtgccctgtgagaattc

SEQ ID NO: 12143 - DNA, 330 bp, Homo sapiens
atccgtatgcaggacccgaacccctacagcttccagtcagacgtctatgcctacggggttgtgctctacgagcttatgactggctcactgccttacagccacattggctgccgtgaccagattatctttatggtgggccgtggctatctgtccccggacctcagcaaaatctccagcaactgccccaaggccatgcggcgcctgctgtctgactgcctcaagttccagcgggaggagcggcccctcttctcccagatcctggccacaattgagctgcttcaacggtcactcccccaagatttgacgggagtgcctccggaaaccctcctt

SEQ ID NO: 12144 - DNA, 609 bp, Homo sapiens
gaatttggccctcgaggccaagaattcggcacgaggtcgggtctgaaagtctgtggggctttgacagagaagcagcgttccagggactccgttcccgccacccgttcagcaaccctctacacctggacccgacctcctcgccttggaggaagaatataagcgtttaaatgcagaattgcaggcaaaaacagctgacgtggttcaacaagctaaggaaataataagagatcggcaagaagtacgatctaggcctgtttcaacacaaatgaaatcatgtgatgacgaagatgattacagtttaagaggtctgttaccatctgaagggatagttcatcttcattcagaaactaagccaaagaccaaaaacattgatcctgtaaacaaggttcaaaacaaattacactctgcaaataaaggaaggaaaacaaattcaagtgttaaattgaaatactctgatgtccaaactgccgacgatgttgccattccagaggatttctcagacttttcccttgcaaaaacaattagcaaaattgaagggcaactggaggaagaaggcttacctgaatatatagatgatattttttctggtgttagtaatgacattggaac

SEQ ID NO: 12145 - DNA, 544 bp, Homo sapiens
gaacaaaataaagctttatttgaactccctcccctacagatcattcagatgcccgggaccatgtccaggttcctctcagcaacatggaaagctaagccatttcacaaacgcacaactgtagctacactacagccccccatgcccagggcacagctttgttgctaagcctgtaacaaaagaccaccactcagtatttgtgtaccctgcagccaacaccacctcctgggcttcacaggttcactcacccaagaggccagcacaaccacgaccgagtgggtactcagtggcccagacaccccccgaacactggcactgcacaaggccctgaagggtagactgtggggcaaagaggacaaactctccctcccctaagggacccggctcactgggcctccttcccctgccaaccgccagcccctgcatgcctagcagggaggtaagcacccactggcgtcgtgatttccattatcttgctaatgttgacagcacctaagtcacattaaaacaaagagagactggatccagacctccaagtctcatcatt

SEQ ID NO: 12146 - DNA, 191 bp, Homo sapiens
ctcgagccgggggagcttcaggaggacagcgggctgtgcgtgctggcccgcctctctgagatcgacgtctccagtgagggtgtcaagggggccaagagcttctttgaggccaaggtccaggccatcaacgtgtccagccgcttcgaggaggagatcaaggcagagcaggaggaaaggaagaagcaggcgga

SEQ ID NO: 12147 - DNA, 262 bp, Homo sapiens; identical to SEQ ID NO: 2509
  misc_feature 186, 188: n = A,T,C or G

SEQ ID NO: 12148 - DNA, 326 bp, Homo sapiens
ggccgccctttttttttttttttaaccaaaaggggtttttggaaagggtccccccctcttttggcccaaaagggttttaagggcccctccccccaaaagaacccccctttggaaaccctggttttcccccgggggggggggaaaaaaaaaggggaccccccacccccaaaacccccggggggggcggggtaaaaacccgggggatttttaaacccccgggggctttaaacacccaaaaagaagaatgggggcttttccccaagggtttttttttggggttcccttttccccttttgggaaaagggaaaaagaaaacctttggaaaa

SEQ ID NO: 12149 - DNA, 271 bp, Homo sapiens; identical to SEQ ID NO: 852
  misc_feature 114: n = A,T,C or G

SEQ ID NO: 12150 - DNA, 330 bp, Homo sapiens
tccccagtgccttttcagagtggcagaatcacaccaccccgaagagccccttcaccagatggcttctcaccatatagccctgaggaaacaaaccgccgtgttaacaaagtgatgcgggccagactgtacttactgcagcagatagggcctaactctttcctgattggaggagacagcccagacaataaataccgggtgtttattgggcctcagaactgcagctgtgcacgtggaacattctgtattcatctgctatttgtgatgctccgggtgtttcaactagaaccttcagacccaatgttatggagaaaaactttaaagaattttgag

SEQ ID NO: 12151 - DNA, 261 bp, Homo sapiens; identical to SEQ ID NO: 853
  misc_feature 48, 55, 150, 169, 213, 222, 239, 257: n = A,T,C or G

SEQ ID NO: 12152 - DNA, 237 bp, Homo sapiens
gcaggagctggagaagtggctgaagaaagagccagaggcctttgactggtccccagtggtgacctatgtgtgtgatcttgaagggaacagagtcaagggtccagagaaggaggagaagttgagacaggcggtcaagcaggtgctgaagtgtgatgtgactcagagccagccactgggggccgtccccttacccccggctgactgcgtgctcagcacactgtgtctggatgccgcctg

SEQ ID NO: 12153 - DNA, 215 bp, Homo sapiens; identical to SEQ ID NO: 854
  misc_feature 63, 75: n = A,T,C or G

SEQ ID NO: 12154 - DNA, 551 bp, Homo sapiens
tggtacgcctgcaggtaccggtccggaattcccgggtcgacccacgcgtccggaaacttactgccttacctaaaagcagcgcagtcaggatattggtaggtcgggggcggctttggaaacccttaagtttacaagcatgcgcggacttgagtgctcattaggtcgccgggcgtccacgtgcagccctggaccctgaaccccggcgtgcgtgggccgtgggccctcggggaaaggttccgtgcactcggggactccggtgaagcctgttcagccgtctgtgtcatgtggccatcttgagtctactctgtcgctcttgtgccctagcaccccgagaaccgtcagtttgagccagatggaagctgagctgaacacattacgatggatgatggaaacataagactatcaagaaatccaagtggtaatgggcgaagtttattcagcatccggcaatggacttatcgtagttggggaaacgggtgttccgaataatatcctggaagttatcaggacacctattttaaatataggcctgaattttgtaaagtaatatt

SEQ ID NO: 12155 - DNA, 430 bp, Homo sapiens
tggtacgcctgcaggtaccggtccggaattcccgggtcgacccacgcgtccggcatggcccagggtgttgaggccagcggtgagagccgtgttagccaagacatggaactgtgttctcaagggttatgtggggcgtgggctctccatagtgtgtatgaaaagcttgttgactctagcggctcagagaggactttgctgggtttctttctgtgaatatctccgtgctgaccatgctggaattggatgattctgcaattcgggacctactgcaggggtccgtttagtaacgtcttgtctgtgatctttgttcttgacctctagaccccaagatgtgaacagtgcacgtgttaatgtcatctttgctcatgtgttataagccccaagttgctgtatattttcacaagtatgtctacacactggtcatgatttt

SEQ ID NO: 12156 - DNA, 183 bp, Homo sapiens
aaacaaagttttggtacaacaagatgcgttaatcttatccaagctctatctattgagtcaatgtattgtcttgagagtatgctaaaactgttgtatgttccttaaccgtgggttttcattgtcttgagatgagaattcatgctttcatattgccagaattctggaagtgttcacagctagggg

SEQ ID NO: 12157 - DNA, 195 bp, Homo sapiens
  misc_feature 144: n = A,T,C or G
acaacgtgcaactgacactcccacccagtctctgctccacctttcagcccacgtcacgtgtagtgtccattttgtgaagccctgttgtgccacagagtgtagccaggtccccctgcagctagtcctagtgaacctcaccccgangccctgcatgggccagcccctccatctgtacttggtccaactgcaactcat

SEQ ID NO: 12158 - DNA, 279 bp, Homo sapiens
  misc_feature 99, 151, 152, 154: n = A,T,C or G
gtttttttgcttacacatggagatagtgtagacaaagtagctgatggattcaaggttgtggcacgttctggaaacatagtagcaggcatagcaaatgantctaaaaagttatatggagcacagttccaccctgaagttggccttacagaanntngaaaagtaatactgaagaatttcctttatgatatagctggatgcagtggaaccttcaccgtgcagaacagagaacttgagtgtattcgagagatcaaagagagagtaggcacgtcaaaagttttt

SEQ ID NO: 12159 - DNA, 254 bp, Homo sapiens
  misc_feature 80: n = A,T,C or G
gaccgccgccgcgccgccatcatggacaccagccgtgtgcagcctatcaagctggccagggtcaccaaggtcctgggcangaccggttctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttg

SEQ ID NO: 12160 - DNA, 535 bp, Homo sapiens; identical to SEQ ID NO: 860

SEQ ID NO: 12161 - DNA, 587 bp, Homo sapiens; identical to SEQ ID NO: 2548

SEQ ID NO: 12162 - DNA, 619 bp, Homo sapiens
cactatagggaatttggccctcgaggccaagaattcggcacgagaagaaaaatcatattttctaatgatttccaccaaattattgcctttaaaggttaatacttagcctctttgcacaacctcaataatggaaatttttacctacctatttttaaaaattttattacttttttttattgaggcataatttaaactcaggaaaattgacaaatatcgtgtatttggtttgatgagtttgagggggaaatgaataaactagtactgacagttgttgaagtaggccaacccggaaaacatgaaatttaaaatattaaagacagtttttaggaaagattctttgtgactggcttcttgcaggtggtttcagttgtgatttgtttttgttcacatggttcaatgtagcagacatctcaatgagtttaaatcactgtgctggatgcataggacattgagaaatgactaaacataggaattatcctcaagaagcttacaatcgaatgaagagtttaaactaactgcacaataaactatagtgaaaggtaggtttaagaaggtagaatagacggaaaattacacggttggtctagtataatttaagctcatggtataatgagcaaca

SEQ ID NO: 12163 - DNA, 433 bp, Homo sapiens
  misc_feature 129: n = A,T,C or G
agaagtagaaatacagtcccccttcggcatcctaatattcttagactgtatggttatttccatgatgctaccagagtctacctaattctggaatatgcaccacttggaacagtttatggagaacttcanaaactttcaaagtttgatgagcagagaactgctacttatataacagaattggcaaatgccctgtcttactgtcattcgaagagagttattcatagagacattaagccagagaacttacttcttggatcagctggagagcttaaaattgcagattttgggtggtcagtacatgctccatcttccaggaggaccactctctgtggcaccctggactacctgccccctgaaatgattgaaggtcggatgcatgatgagaaggtggatctctggagccttggagttctttgctatgaatttttagttg

SEQ ID NO: 12164 - DNA, 574 bp, Homo sapiens
aagaccacagcgaggaggagagtgaagagggcagcggagaccttggtgagcctctttatgaagagccatgcaacgagataagcaaggagcaggccaaagccacccttctggaggaccagcaagacccttcgccctcgtcctaacaccctggcttcagtgcaactcttttccttcagctgcatgtgattttgtgataaagttcaggtaacaggatgggcagtgatggagaatcactgttgattgagattttggtttccatgtgatttgttttcttcaatagtcttattttcagtctctcaaatacagccaacttaaagttttagtttggtgtttattgaaaattaaccaaacttaatactaggagaagactgaatcattaatgatgtctcacaaattactgtgtacctaagtggtgtgatgtaaatactggaaacaaaaacagcagttgcattgattttgaaaacaaacccccttgttatctgaacatgttttcttcaggaacaaccagaggtatcacaaacactgttactcatctactggctcagactgtactactttttttttttttttcccg

SEQ ID NO: 12165 - DNA, 202 bp, Homo sapiens
aaaaatgtgcaattttcatacagcatcccagtgttgatcatggaggttaatgattctttattgttagggacctatcttgtaattccagagttatttatgttttctacagttgaagaggaaaaataccgcttcttattgcctccttttcaggatttcttctggcttcttgagtagctggagtatttttgagagactcctacag

SEQ ID NO: 12166 - DNA, 248 bp, Homo sapiens
  misc_feature 48: n = A,T,C or G
aataaccttccatatttttttaatggctgcataatatttcaagtatgnatatagcataatttataggcagtctcctcttgaaaaaatgtataaatgggaaaatgctttcccaaataatgtggatgtgaaaattcttatacttctatacttggtatttctgttgagcaggttcctataatgggtatttctaggtcctagttcatgtgcattttaaattttgatcacttctgccaaactaccctcagaaa

SEQ ID NO: 12167 - DNA, 218 bp, Homo sapiens
attaacaccacccacaagcacaaaaaagttaggatgaaaatgttcttcaagaatatggtggaataattgtagcctattgaaaattcataaatgaaaattggagtattgtagacagcattcttgaatcacatgtttgtttctgtgtgtaatactgatgactgtcttaaaatttctaacttccaaataaatcatactccactggattataagggcttcaa

SEQ ID NO: 12168 - DNA, 640 bp, Homo sapiens
gtatgtgtgcctgtgtgctctttcaacaaatttattcaattcacagtgatatctgttggacagagtcagcaatcctaccagacaaaactcatacacacattgattccagatgagaaacaacagtcccccaaggagcttgagaaatcacctagggcagccaagctggggaagggaagtggctgtgcattgctgtgtgtcctttaaggctctttggtcctggttgatttcctcttagaaggttccaaataaaacttccctttcctattcagtacacaccagtctttctttggtgtttaacctaatgggctgaggaagggaggcagccaggaaattatacccattaaagtgtgtggttaatgcctatatatatcatttttactcacagttagtggacttatcttttaaaacagaggtatgtggcagtggggtaagagaacttcccttattatagagaagattccaagaataggttcagacatgatttgaagaaccatgtaactctgctgccttgcacggtcccctttttagcactaataactcctaagtgtctgataatttcaaggttagcagcactcccaaagaagctgtccgggctgggtgtggtggctcatggctgtaatcccagcaatttcagaggctg

SEQ ID NO: 12169 - DNA, 264 bp, Homo sapiens
  misc_feature 85: n = A,T,C or G
gggccaatgccctcctggccaatggcgtggagctgagagataaccagctggtggtgccatcagagggcctgtacctcatctactnccaggtcctcttcaagggccaaggctgcccctccacccatgtgctcctcacccacaccatcagccgcatcgccgtctcctaccagaccaaggtcaacctcctctctgccatcaagagcccctgccagagggagaccccagagggggctgaggccaagccctggtatgagcccatctatc

SEQ ID NO: 12170 - DNA, 220 bp, Homo sapiens
agccggcgtcctgccgcgcgatgcccctgctcggacttcttcccaggagggcctgggcttcgctgctcagccagctcctgcgaccgccctgcgcttcgtgcaccggggcggtccgttgccaaagccaggttgcagaggcagtgttaacatcccaactgaaagcacatcaagagaaaccaaattttattatcaagaccccaaagggtaccagggatcttag

SEQ ID NO: 12171 - DNA, 202 bp, Homo sapiens
atttcattgcaagaaatacctgagcttgacagaccgctctcagatcgcccacgccctcaagctcagtgaggtgcaggtcaagatctggtttcagaatcgacgggccaagtggaagcgcatcaaagctggcagtgtgagcagccgttctggggagcccgtaagaaaccccaagattgttgtccccatacctgtgcatgtcaac

SEQ ID NO: 12172 - DNA, 439 bp, Homo sapiens
aaacaacaatacaggctagggatggtaatcctttaaacatacaaaaattgctcgtattataaattacccagtttagaggggaaaaaagaaaataattattcctaaacaaatggataagtagaattaatgattgaggcaggaccctacagagtgtgggaactgctggggatctagagaattcagtgggaccaatgaaagcatggctgagaaatagcagggtagtccaggatagtctaagggaggtgttcccatctgagcccagagataagggtgtcttcctagaacattagccgtagtggaattaacaggaaatcatgagggtgacgtagaattgagtcttccaggggactctatcagaactggaccatttccaagtatataacgatgagccctctaatgctaggagtagcaaatggtcctaggaaggggactgaggatt

SEQ ID NO: 12173 - DNA, 454 bp, Homo sapiens
taaacaaagacgagcaggactaaacgaattcattcagaacctagttaggtatccagaactttataaccatccagatgtcagagcattccttcaaatggacagtccaaaacaccagtcagatccatctgaagatgaggatgaaagaagttctcagaagctacactctacctcacagaacatcaacctgggaccgtctggaaatcctcatgccaaaccaactgactttgatttcttaaaagttattggaaaaggcagctttggcaaggttcttcttgcaaaacggaaactggatggaaaattttatgctgtcaaagtgttacagaaaaaaatagttctcaacagaaaagagcaaaaacatattatggctgaacgtaatgtgctcttgaaaaatgtgaaacatccgtttttggttggattgcattattccttccaaacaactgaaaagctttatttt

SEQ ID NO: 12174 - DNA, 461 bp, Homo sapiens
tcggaacgaggtggttaatgaatccaaaactattttaaagctttgcgattttgggtcggcttcacatgtgtgcggataatgacataacaccttatcttgtcagtagattttatcgtgctcctgaaatcattataggtaaaagctatgactatggtatagatatgtggtctgtaggttgcaccttatacgaactctatactggaaaaattttattccctggcaaaaccaataaccatatgctgaagcttgcaatggatctcaaaggaaagatgccaaataagatgattcgaaaaggtgtgttcaaagatcagcattttgatcaaaatctcaacttcatgtacatagaagttgataaagtaacagagagggagaaagttactgttatgagcaccattaatccaactaaggacctgttggctgacttgattgggtgccagagacttcctgaagaccaacgtaag

SEQ ID NO: 12175 - DNA, 650 bp, Homo sapiens; identical to SEQ ID NO: 3637
  misc_feature 206, 207, 294, 376: n = A,T,C or G

SEQ ID NO: 12176 - DNA, 562 bp, Homo sapiens; identical to SEQ ID NO: 868

SEQ ID NO: 12177 - DNA, 74 bp, Homo sapiens; identical to SEQ ID NO: 3640

SEQ ID NO: 12178 - DNA, 817 bp, Homo sapiens
  misc_feature 476, 537, 548: n = A,T,C or G
gcggccgcccgccgccgcgctcctcctcctcctcctccagcgcccggcggcccgctgcctcctccgcccgacgccccgcgtcccccgccgcgccgccgccgccaccctctgcgccccgcgccgccccccggtcccgcccgccatgcccggcccggccgcgggcagcagggcccgggtctacgccgaggtgaacagtctgaggagccgcgagtactgggactacgaggctcacgtcccgagctggggtaatcaagatgattaccaactggttcgaaaacttggtcggggaaaatatagtgaagtatttgaggccattaatatcaccaacaatgagagagtggttgtaaaaatcctgaagccagtgaagaaaaagaagataaaacgagaggttaagattctggagaaccttcgtggtggaacaaatatcattaagctgattgacactgtaaaggaccccgtgtcaaagacaccagctntggtatttgaatatatcaataatacagattttaagcaactctaccagatcctgacagactntgatatccggntttatatgtatgaactacttaaagctctggattactgccacagcaagggaatcatgcacagggatgtgaaacctcacaatgtcatgatagatcaccaacagaaaaagctgcgactgatagatgggggtctggcagaattctatcatcctgctcaggagtacaatgttcgtgtaacctcaaggtacttcaagggaccagagcttctcgtggactatcagatgtatgaatatagctgggacatggtgagtttgggctggatgctagcaagc

SEQ ID NO: 12179 - DNA, 503 bp, Homo sapiens; identical to SEQ ID NO: 338

SEQ ID NO: 12180 - DNA, 552 bp, Homo sapiens
gcggccgctcgccccctgtgggggccttgccttgggcttcgggccgctgcgttccgccttgccaggcgacaggtgccatgtgtctgtgccgtgcgacatatgaggagcagcggccatcagaggtgtgaggccctcgctggtgcacccctggataacgcccccaaggagtacccccccaagatacagcagctggtccaggacatcgccagcctcactctcttggaaatctcagacctcaacgagctcctgaagaaaacgttgaagatccaggatgtcgggcttgtgccgatgggtggtgtgatgtctggggctgtccctgctgcagcagcccaggaggcggtggaagaagatatccccatagcgaaagaacggacacatttcaccgtccgcctgaccgaggcgaagcccgtggacaaagtgaagctgatcaaggaaatcaagaactacatccaaggcatcaacctcgtccaggcaaagaagctggtggagtccctgccccaggaaatcaaagccaatgtcgccaaagctgaggcggagaagatcaaggcggcc

SEQ ID NO: 12181 - DNA, 468 bp, Homo sapiens
tggtacgcctgcaggtaccggtccggaattcccgggtcgacccacgcgtccgaaacattgtaacattccctttacttgagggcgtccacaataccgtaaggttgcgtgaactgtcctactgaatcttcatggttgcttggattttaatcacatcagaagaatttgagagcataccatggctggcagtccataaaagactagttaggaacatcagcttttaatcatcgaccctgctttcaggtttcattttaaacttatagaagaggggaagacatcagtgtgcttatttggcctttactctaaatcttaaaaggaagaaaattttaatatttcttagtttgagcccaggtgcggtgtctcacgcctgtaatcacagcactttgggaggccaaggcaggcggatcacttgaggtcaggagttcaagaccagcctgccaacgtggtgaaaccctgtctgtactaaaaatt

SEQ ID NO: 12182 - DNA, 565 bp, Homo sapiens
aagcacaagcatgagacctttataacgtcaagtggaaatctgaatacattgaacctgccaaaagagctcatgttgtgccaccaccaagaggaaggggcaggggaggatttggacagggtatacgacctcatgatatttttcgtcagagaaaacagaacacaagtagaccaccatctatgcatgtggatgactttgttgctgctgaaagtaaagaagtggttcctcaagatggaatacctccaccaaaacggccactcaaagtatcacagaagatttcttcccgtggtgggttttcaggcaatagaggaggacggggtgctttccacagtcagaataggtttttcacaccacctgcttcaaaaggaaactacagtcgtcgggaaggaacaagaggctccagttggagtgctcagaatactcctcgaggaaattacaatgaaagtcgtggaggccagagcaattttaacagaggccctcttccaccattacgaccccttagttctacaggttaccgcccaagtcctcgggaccgtgcttctagaggtcgtgggggacttggaccttc

SEQ ID NO: 12183 - DNA, 371 bp, Homo sapiens
gccctgcctctggctccagaacagaaagggagcctcacgctggctcacacaaaacagctgacactgactaaggaactgcagcatttgcacaggggaggggggtgccctccttcctagaggtcctgggggccaggctgacttggggggcagacttgacactaggtcccactcactcagatgtgctgaaattccaccacgggggtcaccctggggggttagggacctatttttaacactagggggctggcccactatgagggctggccctaagatacagacccccccaactccccaaagcggggaggagatatttattttggggacagtttggaggggagggagaatttattaataaaagaatctttaacttt

SEQ ID NO: 12184 - DNA, 586 bp, Homo sapiens; identical to SEQ ID NO: 873

SEQ ID NO: 12185 - DNA, 256 bp, Homo sapiens; identical to SEQ ID NO: 2521
  misc_feature 96: n = A,T,C or G

SEQ ID NO: 12186 - DNA, 409 bp, Homo sapiens
tggtacgcctgcaggtaccggtccggaattcccgggtcgacccacgcgtccgcggacgcgtgggcggacgcgtgggggagtatgcatcagtcttgcagctgctgaggatgttggcaaaggatgaactgatgaccatacttgagaaatgtttcaaggtttttaagtcttattgtgaaaaccaccttggcagcacagctaagagaatagaggagttcctggcccagtttcagagcctcgatgaaaccaaagaggaagaagatgcttctgggtcacagccaaaggggcttcagaagacagacctctatcatcttcagaagtccttattggaaatgaaggagttaagaagaagtaagaagcaaaccaaatttgaagtactcagagaaaatgttgtgaacttcattgactgtct

SEQ ID NO: 12187 - DNA, 235 bp, Homo sapiens
tgttttacctactttaaaagttttaatggattgcacctctgtaaactattcctaaaatgtgtatgatatatttgaaaaggcttccattaatataaaagctttgcttgcagccttccaatctatgttggtttacctgtagtgttttataaagtgtggtcagaggcccctatagaatgtattgtttgaaagtgtagtgatatatttgtgtttttatttcaagtaagtcattttaacc

SEQ ID NO: 12188 - DNA, 225 bp, Homo sapiens; identical to SEQ ID NO: 876
  misc_feature 8, 23, 28, 47, 50, 85, 108, 110, 112, 121, 122, 133, 152,157, 161, 172, 182, 190, 216: n = A,T,C or G

SEQ ID NO: 12189 - DNA, 446 bp, Homo sapiens
cacagcaagggaatcatgcacagggatgtgaaacctcacaatgtcatgatagatcaccaacagaaaaagctgcgactgatagattggggtctggcagaattctatcatcctgctcaggagtacaatgttcgtgtagcctcaaggtacttcaagggaccagagctcctcgtggactatcagatgtatgattatagcttggacatgtggagtttgggctgtatgttagcaagcatgatctttcgaagggaaccattcttccatggacaggacaactatgaccagcttgttcgcattgccaaggttctgggtacagaagaactgtatgggtatctgaagaagtatcacatagacctagatccacacttcaacgatatcctgggacaacattcacggaaacgctgggaaaactttatccatagtgagaacagacaccttgtcagccctga

SEQ ID NO: 12190 - DNA, 418 bp, Homo sapiens; identical to SEQ ID NO: 3647

SEQ ID NO: 12191 - DNA, 166 bp, Homo sapiens
  misc_feature 141, 162: n = A,T,C or G
tgactgtctaaatggaggaacatgtgtgtccaacaagtacttctccaacattcactggtgcaactgcccaaagaaattcggagggcagcactgtgaaatagataagtcaaaaacctgctatgaggggaatggtcacttttnccccggggaaaggccgggccnttga

SEQ ID NO: 12192 - DNA, 560 bp, Homo sapiens; identical to SEQ ID NO: 3648

SEQ ID NO: 12193 - DNA, 506 bp, Homo sapiens
ttctgctcctttgagacccggcgccacctatgtatggtcatggaatacgtggaaggcggcgactgcgccacgctcctgaagaacatgggcccgctgcccgtggacatggcccgcctgtacttcgccgagacggtgttggcgctgtagtacctgcataactatggcatcgtgcaccgtgacctcaaaccagacaatctgctcatcacctcgcttggccacatcaagctcacggacttcggcctgtccaagatcggcctcatgagcatggccaccaacctctatgagggccacatcgagaaggacgcccgagagttcatcgacaagcaggtgtgtgggacgccggagtacatagcccccgaggtgatcttccgccagggctatgggaagccagtggactggtgggccatgggcgtcgtcctctatgagtttctggtgggctgcgtgcctttctttggagatacccccgaggaactcttcggtcaggtggtcagcgatgagatcatgtg

SEQ ID NO: 12194 - DNA, 439 bp, Homo sapiens
  misc_feature 426, 435: n = A,T,C or G
tctcttagccaaaggggccttatcaacattctgaaggcaaaacccctctctcttgtatttgttaaaggcgtggaaggttgctttcacacaggtatgcacggcagctccggaagatcctagaatatccggagtcatcagaggattggaggacagctgacttccatcttgtagccattcattgtacctcaagccagacattttaagccttttgtttggatctactgtgagaagtccttggatcaaatctttagcctcttgggatacattcttccaggcttctccttcaaaggagaaatctccctttttaattttcttcatgatttccaccgcgctggtacacgtcaaacttcggtcatgagattggaagggaacctgtcctgacaacattgtgtacaaaatgacgcccaagctccacaggtcacaggnctcatcgtngcgg

SEQ ID NO: 12195 - DNA, 520 bp, Homo sapiens; identical to SEQ ID NO: 3649

SEQ ID NO: 12196 - DNA, 473 bp, Homo sapiens; identical to SEQ ID NO: 3650

SEQ ID NO: 12197 - DNA, 567 bp, Homo sapiens; identical to SEQ ID NO: 879

SEQ ID NO: 12198 - DNA, 504 bp, Homo sapiens; identical to SEQ ID NO: 3651

SEQ ID NO: 12199 - DNA, 245 bp, Homo sapiens
gcctatatgcaaagtattttatcagggacttgaacaaagacctcactctttttcacttgtcttatgtcgagagaaaaggttattggcagccacattcctaagactggggaatggtgtgtccttttaaatttgaagatgactttaggtaattatggaaactcctcaaagaggagaaagtaatttttttccagacatttttctcattctgtgtctttcacacactagtttccatagttcgagaattc

SEQ ID NO: 12200 - DNA, 259 bp, Homo sapiens
cgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaa

SEQ ID NO: 12201 - DNA, 256 bp, Homo sapiens
  misc_feature 88: n = A,T,C or G
ggattatgatagggacaaggatgataaaatttcctgggaagaatacaaacaagccacctatggttactacctaggaaaccccgcagantttcatgattcttcagatcatcacacctttaaaaagatgctgccacgtgatgagagaagattcaaagctgcagacctcaatggtgacctgacagctactcgggaggagttcactgcctttctgcatcctgaagagtttgaacatatgaaggaaattgtggttttggaa

SEQ ID NO: 12202 - DNA, 157 bp, Homo sapiens
ggggaaaacttttggttttttaaaaaaaaagggggttttcccatgggaaaaggggggggcccaaacccccaaccttgggggaatccccccctttaacccccaaaaggggggggaaaaaaggggggaacccttttccccaaacaattatttttttttt

SEQ ID NO: 12203 - DNA, 252 bp, Homo sapiens; identical to SEQ ID NO: 60

SEQ ID NO: 12204 - DNA, 372 bp, Homo sapiens
  misc_feature 20, 26, 27, 358: n = A,T,C or G
acaaccagaaagtggatctnttcagnntgggaattatcttctttgagatgtcctatcaccccatggtcacggcttcagaaaggatctttgttctcaaccaactcagagatcccacttcgcctaagtttccagaagactttgacgatggagagcatgcaaagcagaaatcagtcatctcctggctgttgaaccacgatccagcaaaacggcccacagccacagaactgctcaagagtgagctgctgcccccaccccagatgggaggagtcagagctggcatgaagtgctggcaccacacgctggaccaacgtgggatggggaagggccttaccgcaccattgatgggcccagatctttntcggcagcgcattt

SEQ ID NO: 12205 - DNA, 416 bp, Homo sapiens; identical to SEQ ID NO: 2682

SEQ ID NO: 12206 - DNA, 469 bp, Homo sapiens
aaccaagggaccattaagctgtgtgactttggcagtgccacgaccatctcgcactaccctgactacagctggagcgcccagaggcgagccctggtggaggaagagatcacgaggaatacaacaccaatgtatagaacaccagaaatcatagacttgtattccaacttcccgatcggcgagaagcaggatatctgggccctgggctgcatcttgtacctgctgtgcttccggcagcacccttttgaggatggagcgaaacttcgaatagtcaatgggaagtactcgatccccccgcacgacacgcagtacacggtcttccacagcctcatccgcgccatgctgcaggtgaacccggaggagcggctgtccatcgccgaggtggtgcaccagctgcaggagatcgcggccgcaagcttattccctttagtgagggttaattttagcttggcactggccgtcgttttacaac

SEQ ID NO: 12207 - DNA, 445 bp, Homo sapiens; identical to SEQ ID NO: 3655

SEQ ID NO: 12208 - DNA, 532 bp, Homo sapiens
tagggccctgccgggagctacaggccctacgacgagggtctgcggaggggggttttcatcaccaacgagaccggccagccgctgattgggaaggtatggcccgggtccactgccttccccgacttcaccaaccccacagccctggcctggtgggaggacatggtggctgagttccatgaccaggtgcccttcgacggcatgtggattgacatgaacgagccttccaacttcatcaggggctctgaggacggctgccccaacaatgagctggagaacccaccctacgtgcctggggtggttggggggaccctccaggcggccaccatctgtgcctacagccaccagtttctctccacacactacaacctgcacaacctctacggcctgaccgaagccatcgcctcccacagggcgctggtgaaggctcgggggacacgcccatttgtgatctcccgctcgacctttgctggccacggccgatacgccggccactggacggtggacgtgtggagctcctgggagcagctcgcct

SEQ ID NO: 12209 - DNA, 581 bp, Homo sapiens; identical to SEQ ID NO: 3657

SEQ ID NO: 12210 - DNA, 625 bp, Homo sapiens; identical to SEQ ID NO: 3658

SEQ ID NO: 12211 - DNA, 549 bp, Homo sapiens; identical to SEQ ID NO: 884

SEQ ID NO: 12212 - DNA, 657 bp, Homo sapiens
ttcggcacgagggaaaacaggtctgaaacaaggtcttacccccagctgcttctgaacacagtgactgccagatctccaaacatcaagtccagctttgtccgccaacctgtctgacatgtcgggacccgtgccaagcagggccagagtttacacagatgttaatacacacagacctcgagaatactgggattacgagtcacatgtggtggaatggggaaatcaagatgactaccagctggttcgaaaattaggccgaggtaaatacagtgaagtatttgaagccatcaacatcacaaataatgaaaaagttgttgttaaaattctcaagccagtaaaaaagaagaaaattaagcgtgaaataaagattttggagaatttgagaggaggtcccaacatcatcacactggcagacattgtaaaagaccctgtgtcacgaacccccgccttggtttttgaacacgtaaacaacacagacttcaagcaattgtaccagacgttaacagactatgatattcgattttacatgtatgagattctgaaggccctggattattgtcacagcatgggaattatgcacagagatgtcaagccccataatgtcatgattgatcatgagcacagaaagctacgactaatagactggggtttggctgagtt

SEQ ID NO: 12213 - DNA, 547 bp, Homo sapiens
tatttattatttttcagttaaatatttattgaacaaatgcagagtaaatgaactaagggctgttataaccttaagttacaacaaacaacttcaaatattcagagggctgtcacacagagaatgaaagacttgctcagtatttctccaaagggcagaacttgagccaagcgataaatataagcaaccaatgggctgcaggatagttgtacaaagtgtatcatgtatcttcatagcttctttgcccatataatgcattccacacttaagtttctccttctaaaaggcgacacgacaagttaatatgtctcataaatgtcttaaataagttgcattttcatggcaagccctccactgccagcaatggatatactcacactattggaaaaaatctaaagttaacaaactggtttagtatggaaatggtctatttgttcctcagctatgtttctgtatcttacattagtggctctcaggaggtggggggtgaaaagagagcatgttctccaaagagggtgaatcataatccccagtgattcagatactgtgc

SEQ ID NO: 12214 - DNA, 595 bp, Homo sapiens; identical to SEQ ID NO: 3661

SEQ ID NO: 12215 - DNA, 529 bp, Homo sapiens; identical to SEQ ID NO: 3662

SEQ ID NO: 12216 - DNA, 325 bp, Homo sapiens; identical to SEQ ID NO: 3663

SEQ ID NO: 12217 - DNA, 265 bp, Homo sapiens
  misc_feature 16: n = A,T,C or G
catgggtggggcggangtctgggatgcgctgggagcctaggatccccgacagttttgcagaacactgaaatctatggactctaaaatggacttcatttaaagaaacccacggaccattaatggacaaaaacatgagtcaatatgtattgtggcattcaaatcctagcactctgggagagcatcaagtaccacgtttttgaagaccatggcctatcatcattatgcattcaagatttgagtttgaataacctcatcaagacttaga

SEQ ID NO: 12218 - DNA, 181 bp, Homo sapiens; identical to SEQ ID NO: 3664

SEQ ID NO: 12219 - DNA, 303 bp, Homo sapiens
aagcaatgagccgattctgtgaggccgagttctcggtcaagacccgaccccactggtgctgcacgcggcagggggaggctcggttctcctgcttccaggaggaagctccccagccacactaccagctccgggcctgccccagccatcagcctgatatttcctcgggtcttgagctgcctttccctcctggggtgcccacattggacaatatcaagaacatctgccacctgaggcgcttccgctctgtgccacgcaacctgccagctactgaccccctacaaagggagctgctggcactgatcc

SEQ ID NO: 12220 - DNA, 168 bp, Homo sapiens; identical to SEQ ID NO: 886
  misc_feature 85, 128, 146: n = A,T,C or G

SEQ ID NO: 12221 - DNA, 105 bp, Homo sapiens
ggggtcgcctttggagcagagaggaggcaatggccaccatggagaacaaggtgatctgcgccctggtcctggtgtccatgctggccctcggcaccctggccgagg

SEQ ID NO: 12222 - DNA, 580 bp, Homo sapiens; identical to SEQ ID NO: 887

SEQ ID NO: 12223 - DNA, 257 bp, Homo sapiens
cccacgcgtccgcccacgcgtccgaaaacgtgtctcaacaaaaacatcagctgcagatcttgtgacagaaacagatcaccttgtggaagatttaattatttctgagttgcgagagaggtttccttcacacaggttcattgcagaagaggccgcggcttctggggccaagtgtgtgctcacccacagcccgacgtggatcatcgaccccatcgacggcacctgcaattttgtgcacagattcccgactgtggcggtta

SEQ ID NO: 12224 - DNA, 491 bp, Homo sapiens
gtgcaaagcccagcaccccaacggcaacaaagaaaagaacgtgcctcttccaggtgagggccgggcccagccaccgggacagagagggagccgaagggggcgggagtggcgggcaccgggctgacacgtgtccctcactgcagtgattgctgagctgcctcccaaagtgagcgtcttcgtcccaccccgcgacggcttcttcggcaacccccgcaagtccaagctcatctgccaggccacgggtttcagtccccggcagattcaggtgtcctggctgcgcgaggggaagcaggtggggtctggcgtcaccacggaccaggtgcaggctgaggccaaagagtctgggcccacgacctacaaggtgaccagcacactgaccatcaaagagagcgactggctcagccagagcatgttcacctgccgcgtggatcacaggggcctgaccttccagcagaatgcgtcctccatgtgtgtccccggtgagtgacctg

SEQ ID NO: 12225 - DNA, 317 bp, Homo sapiens
tggtacgcctgcaggtaccggtccggaattcccgggtcgacccacgcgtccgcaatctgcctcactgctgttctgggccatccccatagccatgtttacatgatttgatgtgcaatagggtggggtaggggcagggaaaggactgggccagggcaggctcgggagatagattgtctcccttgcctctggcccagcagagcctaagcactgtgctatcctggaggggctttggaccacctgaaagaccaaggggatagggaggaggaggcttcagccatcagcaataaagttgatcccagggtttgctttgttttttt

SEQ ID NO: 12226 - DNA, 253 bp, Homo sapiens
  misc_feature 121, 123, 136, 140, 147, 151, 158, 160, 182, 190, 195, 203,226, 231, 235: n = A,T,C or G
gtccgacgttggcctacccagtcggaaggcagagctgcaatctagttaactacctcctttcccctagatttcctttcattctgctcaagtcttcgcctgtgtccgatccctatctactttntntcctcttgtaggnaagnctaagantccnggtttgngntaggttttgtttttctccgggngagatttngaagnccatgttngggaacttttattatcaacaagngaggnaggnagtttttatcacccaccc

SEQ ID NO: 12227 - DNA, 151 bp, Homo sapiens; identical to SEQ ID NO: 891
  misc_feature 56, 65, 71, 87, 91, 107, 133: n = A,T,C or G

SEQ ID NO: 12228 - DNA, 572 bp, Homo sapiens
ggaatttggccctcgaggccaagaattcggcacgagctaggaatagatttacagaagatctcaggccagaatggtacctttaaaaagtcaactgtcctgcaattaggtatccgaatgttggatgtactggaatatatacatgaaaatgaatatgttcatggtgatataaaagcagcaaatctacttttgggttacaaaaatccagaccaggtttatcttgcagattatggactttcctacagatattgtcccaatgggaaccacaaacagtatcaggaaaatcctagaaaaggccataatgggacaatagagtttaccagcttggatgcccacaagggagtagccttgtccagacgaagtgacgttgagatcctcggctactgcatgctgcggtggttgtgtgggaaacttccctgggaacagaacctgaaggaccctgtggctgtgcagactgctaaaacaaatctgttggacgagctcccccagtcagtgcttaaatgggctccttctggaagcagttgctgtgaaatagcccaatttttggtatgtgctcatagtttagcatatgatga

SEQ ID NO: 12229 - DNA, 765 bp, Homo sapiens
  misc_feature 588, 659, 724: n = A,T,C or G
tatcataaagtttaattatgattcagaaaaaatcgagcgaataactttctctgaaaaaatatattgactctgtatagaccacagttattgggggagaagggctggtaggttaaattatcctattttttattctgaaaatgatattaatagaaagtcccgtttccagtctgattataaagatacatatgcccaaaatggctgagaataaatacaacaggaaatgcaaaagctgtaaagctaagggcatgcaagagaaaatctcagaatacccaaagtggcaacaaggaacgtttggctggaatttgaagttatttcagtcatctttgtctttggctccatgtttcaggatgcgtgtgaactcgatgtaattgaaattcccctttttatcaataggtgcttctctgtacagctcatccacttcctcatctgtaaaccgatcccccatggttgtcagcagctctctcaagaatcttcctgtatggtgccagttgcttcttcatcaaagcaagcaaaggcatttctgatgacatcttcaggatctgtgccatttaacttctcaccaaacatggtgaggaacatggtgaaatngatggggcctggagcctcattcatcatggcatctagatacctcatcagtgggatcttccccaatgaagcangcatctcatgcaaatcttccttgcgatgaaacccatcttggtctggatcaatcatgtgaaggctntttgacctcctgatctggactgtcaaacaagcaaacccatt

SEQ ID NO: 12230 - DNA, 263 bp, Homo sapiens; identical to SEQ ID NO: 3667

SEQ ID NO: 12231 - DNA, 432 bp, Homo sapiens
taccggtccggaattcccgggtcgacccacgcgttcggtgattacacgcgtgtgccaccacgctcggctaatttttgtatttttagtagagatgggatttcaccatgttggccaggctggtctcgaactactgacctcgtgatccacctgccacggcctcccaaagtgctgggattacaggcgtgagccaccatgctcggcctaaaaaacaattttcttgaagaatccgattttgtgcatagtaatgacacagcaccattcctgagaaataggaaatatatgtgtgtggtatgaaaagcccatattctgttcttgtcacctgaatctaggcttcctctttggatgtgaacgcgggaatgaacagtggctgttttccacccaaaggggcgtggagaccttttggaaacgggctttctcctttccattttgcag

SEQ ID NO: 12232 - DNA, 214 bp, Homo sapiens; identical to SEQ ID NO: 896
  misc_feature 137, 161: n = A,T,C or G

SEQ ID NO: 12233 - DNA, 475 bp, Homo sapiens; identical to SEQ ID NO: 3668

SEQ ID NO: 12234 - DNA, 505 bp, Homo sapiens; identical to SEQ ID NO: 3669

SEQ ID NO: 12235 - DNA, 542 bp, Homo sapiens
gaaagctggtacgcctgcaggtaccggtccggaattcccgggtcgacccacgcgtccgcccacgcgtccgcaaaaacaccaaaaggaacaaaggggcctgcgttaaaacctaattgctaatgcttcacaactaggagagcatgccgtcttgatgtttaaaaaacccagggtctccacccttcctttgatttgtgcaattctgtcttccacagttccggagccttcagtgaggggtagctacatgccccatgcctgccctttctttccttctttgctcactttactatgggtgtattttaatcttgtataaaaatatgcatgaatgagtcatgcacatgtatacgttatgtatttgacaagtggtggtgaaacaaaatcaaaacagatttgatttgtgtttttgaaatgtcagtacattttgtgccactaacactgtgatgtataaaagagctgtttgaatgccttttaatgttgtgttttgtactctggaatcatatggaaaaagtttgatttgtaatttcaatacatattttaaatgtatt

SEQ ID NO: 12236 - DNA, 166 bp, Homo sapiens
  misc_feature 3, 87, 88, 89, 123: n = A,T,C or G
tgnaacattagacaggatgctgatcttctggacaatcacacttttcctgctgggagcagccaaaggaaaagaagtttgctatgaggnnntcgggtgcttttctgacactgagccctggggcgngacagcaatcaggcccctgaaaattctcccctggagccctgag

SEQ ID NO: 12237 - DNA, 213 bp, Homo sapiens
ggccgcccttttttttttttttttttttttttttggggggggaaaaaaaaattttttgggggggtaaaaaaagggaaaaaggggaaaccaaaaaagtgttttttccccccggggctttttttaaaaaaaaaaagggggaaaccccggggggttgggggggtaaaaatttttggggggttccctgggggggggaaaaaccccttaaaaaaattg

SEQ ID NO: 12238 - DNA, 159 bp, Homo sapiens
ggccgccctttttttttttttttttttttttttttttttttttttaaatattttttaaaaaaaaaaaaaaaaattttttttttaaaaaaggggggggacggggggggggggaaagggccccccccccggggcccccgggggtccccccccaaaaaaaat

SEQ ID NO: 12239 - DNA, 184 bp, Homo sapiens
  misc_feature 6, 70, 100, 103, 148: n = A,T,C or G
gttctntacatggtgacagacctggagctgtacgaagccttctttcggtgcaaggaaattggagcaattncccaggtccatgcggaaaatggagacttanttncagagggagcaaagaagatgttggctctggggataacaggccctnagggcacgagctgtgccgcccagaggcagtggaggc

SEQ ID NO: 12240 - DNA, 689 bp, Homo sapiens
  misc_feature 488, 568, 669, 679: n = A,T,C or G
tgttccttttttgatggggtgtgggggtatagtactcagcttatgccctaaaataacatgtataaaaacccctgaagtattgtgtgggtgtgtacgtgtgagtgtgtgtttgtatacgtctggcaattaaagctttgtcttctggaacttagtgaattcttttctctttttcctccagaagtatttgttacaagatttgtaaataagagctctacttagtttgtttaccatgaacatgttgcagcaaaccttatgcatctaattcctacaaggttaaagaaaggcttttagacttgccaggttaagcaacagccaagttctcagtaattgtttgccttgatttatcttttagacttcattttgccagctctaaaactcccagtcttccttgattttagtccttaatcttttatgttctgagcaggaagggtaaaagacaggaacctgcttcactgtattaactagtccatgggctgagaccggggcantcttttctccaactgcatgttgctagatcatgatcagcaccagaggttgggcatcttgcaaaaccttacagtgctgaaantgcagcatggtactaaggagtaaagttgaaggaccctttattaaaggttttccttaattaatgaatgggtgaaggacagattgtgccagtcggaatcagtnacagcatggngacgggagct

SEQ ID NO: 12241 - DNA, 277 bp, Homo sapiens; identical to SEQ ID NO: 304
  misc_feature 66, 88, 99, 102, 103, 139, 144, 181, 196, 208, 255, 277: n = A,T,C or G

SEQ ID NO: 12242 - DNA, 458 bp, Homo sapiens; identical to SEQ ID NO: 295
  misc_feature 1, 317, 423, 435: n = A,T,C or G

SEQ ID NO: 12243 - DNA, 480 bp, Homo sapiens
  misc_feature 87, 458: n = A,T,C or G
agagaggtcccaagcaactagcccctcaccccaacatcatccgggttctccgcgccttcacctcttccgtgccgctgctgccagggncctggtcgactaccctgatgtgctgccctcacgcctccaccctgaaggcctgggcatggcggacgctgttcctcgttatgaagaactatccctgtaccctgcgccagtacctttgtgtgaacacacccagcccccgcctcgccgccatgatgctgctgcagctgctggaaggcgtggaccatctggttcaacagggcatcgcgcacagagacctgaaatccgacaacatccttgtggagctggacccagacggcttgcccctgggtgggtgatcgcagattttgggctgctgcctgggttgatgagagcatcggccttgcagttgccctttcagcagctggtaacgttggattcggggccggaaacggctnttttgattggccccagaggttt

SEQ ID NO: 12244 - DNA, 176 bp, Homo sapiens
gaatttggccctcgaggccaagaattcggcccgaggcctcgtgccgtgggtgcctgtgggtgcggctgctcaggaggctgaagcacaagaatcgcttgaacccgggaggtggaggttggagtgagccaggatcatgctactgcactctccagcctgggctacagagtgagactctc

SEQ ID NO: 12245 - DNA, 585 bp, Homo sapiens
  misc_feature 525: n = A,T,C or G
gaatttggccctcgaggccaagaattcggcacgaggcctttggctaaatggcaccgctgtaaagagggtctgactgagcgctttgagctgtttgtcatgaagaaagagatatgcaatgcgtatactgagctgaatgatcccatgcggcagcggcagctttttgaagaacaggccaaggccaaggctgcaggtgatgatgaggccatgttcatagatgaaaacttctgtactgccctggaatatgggctgccccccacagctggctggggcatgggcattgatcgagtcgccatgtttctcacggactccaacaacatcaaggaagtacttctgtttcctgccatgaaacccgaagacaagaaggagaatgtagcaaccactgatacactggaaagcacaacagttggcacttctgtctagaaaataataattgcaagttgtataactcaggcgtctttgcatttctgcgaaagatcaaggtctgcaagggaattcttgtgtgctgctttccatttgacaccgaanttctgttcagccatcagaagagagacaaggaattaaaaatttctttttaatcctgttacc

SEQ ID NO: 12246 - DNA, 526 bp, Homo sapiens; identical to SEQ ID NO: 3670

SEQ ID NO: 12247 - DNA, 518 bp, Homo sapiens; identical to SEQ ID NO: 3673

SEQ ID NO: 12248 - DNA, 813 bp, Homo sapiens
  misc_feature 659: n = A,T,C or G
acaaacagtaagaaacactttattataactttataacatataaatagcttgggtcaaatctgtgctttctggcagctgggcaccaagtctgctcccctgcaggctcctgccttccttcacattgcactgttcattgggtggctctggcctggggcatggcggtcgaggctggagtcaaggggctgggcggccagtcccgccctccatctcctcatgcggtggcctgtgcctgtcatctgcttgggttgcggctggtgtggaaggaccgctcctcaggggtcaggccagcaaagaaggggtgcagcagggcctcggctagtgtgatgcgctgggcagggtcaaattctaacatcctcctcatcaggtcaaacagctgcacgtgctccagggagtcttggagcatgtaactcttcagaggtttgcagttctccttcacataccggccgtcagagctgttctcatcccaaactaggccccctttgtagaaatatttctgcttcctggtacggtggatcatgtgtgatgggatgggccctagggtcttctccatcatcaccaggtgctctcggtttttctggttcctgaaaaattttaagccccggtagttctcataagaaatgcagccatgctccagacgtcacagggctgtccagcccagnctaaggattacctcaagcgggcgatagttaacggtggcaacaatggttgtgttgttctcatggttaattgtggaactccaaagttaccaaccggatgctggttgtcttccatgacttttctcaaactcttgtggccattgtagagggtttcaaa

SEQ ID NO: 12249 - DNA, 538 bp, Homo sapiens
ccctcgaggccaagaattcggcacgaggccacactcccagccaaagtctacgtgggtgtgaaacaggagatcgccgagatgcggatacctgccctcaacgcctacatgaagagcctgctcagcctgccggtctgggtgctgatggatgaggacgtccggatcttcttttaccagtcgccctatgactcagagcaggtgccccaggcactccgccggctccgcccgcgcacccggaaagtcaagagcgtgtccccacagggcaacagcgttgaccgcatggcagctccgagagcagaggctctatttgacttcactggaaacagcaaactggagctgaatttcactggagatgtgatcttcctcctcagtcggatcaacaaagactggctggagggcactgtccggggagccacgggcatcttccctctctccttcgtgaagatcctcaaagacttccctgaggaggacgaccccaccaactggctgcgttgctactactacgaagacaccatcagcaccatcaagtctgtggcctggg

SEQ ID NO: 12250 - DNA, 53 bp, Homo sapiens
ctcactatttggaatttggccctcgaggccaagaattcggcacgaggacagat

SEQ ID NO: 12251 - DNA, 289 bp, Homo sapiens; identical to SEQ ID NO: 3676

SEQ ID NO: 12252 - DNA, 203 bp, Homo sapiens; identical to SEQ ID NO: 903

SEQ ID NO: 12253 - DNA, 626 bp, Homo sapiens; identical to SEQ ID NO: 3679

SEQ ID NO: 12254 - DNA, 259 bp, Homo sapiens
  misc_feature 258: n = A,T,C or G
ctttgctcagccccctctgttctgctgattgtagggatgtgcagggctgggagttggcactccccccgagtggggaggtgacagcttgtcacagtagccaggcttgggtgggttcagcactagctcgggacggtgtgtcacacgtctatagtaaaccagttctctgggaggggaaaaaagccctgatttattgcatttgggcagcttctgtggtgtaaattctcccagcagtgtcccatgtcatgctgccagcatcana

SEQ ID NO: 12255 - DNA, 462 bp, Homo sapiens
gaaactggtacgcctgcaggtaccggtccggaattcccgggtcgacccacgcgtccgctgacttattcttggagcgcttagctttccctgacctttggcttcaccctctgataccaactgattatattaaaaacttaccaatgtggcgatttaaatgtcttggagtccagtctgaagaggaaatgtcggaggggtctcaagatactgaaaatgactcggaaagtgagaacacagacactttgagtagtgagaaggaagtatttgaagataagcaaagcgtacttcacaattctccaggaacagcaagtcactgtgatgctgaggcttgttcatgtgccaataaatattgtcagaccagcccatgtgaaaggaaggggaggtcatatggatcatataacactaatgaagatatggaacctgattggttaacttggcctgctgatatgctgcactgtactgaat

SEQ ID NO: 12256 - DNA, 448 bp, Homo sapiens
tggtacgcctgcaggtaccggtccggaattcccgggtcgacccacgcgtccggtcattaacttgtcagtacctatagttctgactgcgactcatgaagataaagagaggctggacggctgtacagcatttgctctgatgtatgaaggccgccgtgtggccattcttcgcaatccagagttttttgagcacaggaaagaagagcgctgtgccagacagtggggaacgacatgcaagaaccacccctatattaagatggtgatggaacaaggagattggctgattggaggagatcttcaagtcttggatcgagtttattggaatgatggtcttgatcagtatcgtcttactcctactgagctaaagcagaaatttaaagatatgaatgctgatgctgtctttgcatttcaactacgcaacccagtgcacaatggacatgccctgttaatg

SEQ ID NO: 12257 - DNA, 243 bp, Homo sapiens; identical to SEQ ID NO: 907
  misc_feature 15, 26, 55, 68, 97, 102, 132, 136, 156, 169, 192, 205, 226: n = A,T,C or G

SEQ ID NO: 12258 - DNA, 484 bp, Homo sapiens; identical to SEQ ID NO: 3680

SEQ ID NO: 12259 - DNA, 300 bp, Homo sapiens
  misc_feature 19, 21, 34, 114, 130, 135, 139, 143, 210, 217, 243, 261,277, 299: n = A,T,C or G
gaaaaactgtgaattattnanacggaagctctgnagcctggacaacggggactgtgaccagttctgccacgaggaacagaactctgtggtgtgctcctgcgcccgcgggtacancctggctgacaacggnaaggnctgnattnccacagggccctacccctgtgggaaacagaccctggaacggaggaagaggtcagtggcccaggccancagcagnagcggggaggcccctgacagcatganatggaagccatatgatgnagccgacctggacccnaccgagaaccccttcgacctgnt

SEQ ID NO: 12260 - DNA, 153 bp, Homo sapiens
ggccgccctttttttttttttttaaaataaaaggccttaatttgggggggggcccagggggcccctttggggggaaaagggccaattttttaaccccccacccaggtttttggggaaagaaagggggggaaaaaaaaaaccgggggggggccc

SEQ ID NO: 12261 - DNA, 125 bp, Homo sapiens
ctctgctggaggattgattcatgagatcttactgttggaaaacgcttcaaagagcaaataacttcctgtggcccttcaaattgtcttctccacgatgtggaatgaagaaaaagaccacccatttt

SEQ ID NO: 12262 - DNA, 278 bp, Homo sapiens
  misc_feature 213, 222, 255: n = A,T,C or G
ggcccgcaagcggctcaccaagcgctcggaggaggtggtgcgtctgctggtgacgcggcagtcgctgcagaaggccgtgcagcagtccatgctgtcctagcagccaccaccatctgcgactcctgcctgccgcctctctgtacagtaacgccacttccacactctgtccccatctggcttctgctgaccgctgggccccagctcagaagggcnatagctggncccagaggcctggcctggccttccttcccttcncccatccctggcctggggcctct

SEQ ID NO: 12263 - DNA, 256 bp, Homo sapiens; identical to SEQ ID NO: 58

SEQ ID NO: 12264 - DNA, 576 bp, Homo sapiens
  misc_feature 565: n = A,T,C or G
aagaagataggccgaggacagttcagcgaggtgtacaaggccacctgcctgctggacaggaagacagtggctctgaagaaggtgcagatctttgagatgatggacgccaaggcgaggcaggactgtgtcaaggagatcggcctcttgaagcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcttcgtgaagctcggtgaccttggtctgggccgcttcttcagctctgagaccaccgcagcccactccctagttgggacgccctactacatgtcaccggagaggatcatcagaacggctacaattaagtccgacatctggtcttggctgtctgctgtanagatggcagcc

SEQ ID NO: 12265 - DNA, 421 bp, Homo sapiens
acacaaagccaaatcacagaatgactggaagtgctcacacaaccaagccaagaagcgcgttgtgtttgctgactccaagggcctctctctcactgcgatccatgtcttctccgacctcccagaagaaccagcgtgggatctgcagtttgatctcttggaccttaatgatatctcctctgccttaaaacaccacgaggagaaaaacttgattttagatttccctcagccttcaaccgattacttaagtttccggagccactttcagaagaactttgtctgtctggaaaactgctcgttgcaagagcgaacagtgacagggactgttaaagtcaaaaatgtgagttttgagaagaaagttcagatccgtatcactttcgattcttggaaaaactacactgacgtagactgtgtctatatgaaa

SEQ ID NO: 12266 - DNA, 521 bp, Homo sapiens; identical to SEQ ID NO: 3685

SEQ ID NO: 12267 - DNA, 130 bp, Homo sapiens
  misc_feature 41, 62, 71, 108, 116: n = A,T,C or G
ggatatacaagatgacgcccaggctccacaggtcgcagcgnttgtcgtagatgctagcctcntcgctgaangcctccactaactccggggccatgtactccgcgagcngcacggantatgcagctccggg

SEQ ID NO: 12268 - DNA, 491 bp, Homo sapiens
tggtacgcctgcaggtaccggtccggaattcccgggtcgacccacgcgtccgcatttatccagaggtgtatgtgccagaccttaatcctgttatatctggatacattaaaagcgttggtcagcctctatgtctggatgttggagaaaacaatcaaggaggcaaaccattaattatgtatacatgtcatggacttgggggaaaccagtactttgaatactctgctcaacatgaaattcggcacaacatccagaaggaattatgtcttcatgctgctcaaggtctcgttcagctgaaggcatgtacctacaaaggtcacaagacagttgtcactggagagcagatatgggagatccagaaggatcaacttctatacaatccattcttaaaaatgtgcctttcagcaaatggagagcatccaagtttagtgtcatgcaacccatcagatccactccaaaaatggatacttagccaaaatgattaagtgttcctt

SEQ ID NO: 12269 - DNA, 238 bp, Homo sapiens
  misc_feature 6, 12, 30, 78, 81, 86, 102, 111, 133, 159, 167, 169, 171,175, 196, 225: n = A,T,C or G
gtccancaacgnccgggccgagggcgactnatgggttctgaatggaaccaaagcctgggtcaacaatgcctgggaggnttnggctnccgtggtctttgccancacggacanaggcctgcaaaacaagggcatnaagtgcctttctggtcccattccaanggctgggntnanggtngggaaggaaggagacaagctnggcatccgggcttatccacgggcaaactnattttgagggctt

SEQ ID NO: 12270 - DNA, 502 bp, Homo sapiens; identical to SEQ ID NO: 3688
  misc_feature 383: n = A,T,C or G

SEQ ID NO: 12271 - DNA, 232 bp, Homo sapiens; identical to SEQ ID NO: 910

SEQ ID NO: 12272 - DNA, 193 bp, Homo sapiens
catcccaaacggtcaactgatccaactccctgtggctgagattgtggttaaagatattgcccaggtcaaatacggagatctgctgtctgcggatggaatcctgatccaagggaatgatttgaagattgatgagagctctctgacaggggaatctgaccatgtcaacaagtccctggacaaagaccccatgttg

SEQ ID NO: 12273 - DNA, 484 bp, Homo sapiens
ggcctttggttttttccagagttagatcctctcagaacagagtctgggagaactccaatgctgaatggagaagggtaataggttggtgcagtgaatgggctgggggtggggtggccttctccaggcctgagtgtttttgtgtccagctcagtatctgcaacaagaagtttcccacttgtggatgtttagtgcagccacagacttgtattttgatccccaatttttttttgaaagagttctcctcataggaggatgattcaccatcaaaagaaaaaggaccccataccttggtgtcattaacataattattttaagccttatccagcagccataatttgaataactctacgagaccagagagactgtagttccctattttaacctcaattatgcatttgtcccccaaccccactgaaaactaaatgctgtaccacagagccgggtgtgaactatggtttaaaaggttcaagtttccatttaaagt

SEQ ID NO: 12274 - DNA, 304 bp, Homo sapiens
  misc_feature 1, 17, 222, 237, 296: n = A,T,C or G
ntttttttttaatcagnctcatgaaaggtgctatgactcagcaattcaaaggccatgcaaacatggttccggaatgtgaaactttccagcatgtggataacgttcatactaccagttttatcctgtttcttaagatgctccaaaatccgggatctcctcagctgcttgacgatgaaagcgcttctcattgcgcaccatttttagggccacggtactgtcgangtttgtgatcatagnaccctgggccacctgcccaaaactccccttgccaataattttcaggcacctcatatcgntaaggcta

SEQ ID NO: 12275 - DNA, 586 bp, Homo sapiens
tcggcacgaggggcaggagagggaaaggcagcggcggcggcagctggaggatgaagaaggagcatgtgcttcactgccagttctccgcgtggtacccgttcttccgaggcgttaccatcaagagtgtcattcttccacttcctcagaatgtgaaggattatttactcgatgatggaactctggtggtttcaggaagggatgatccaccaacacattctcagccagacagtgatgatgaagcagaagaaatacagtggtctgatgatgagaacacagccacgcttacggcaccagaatttcctgagtttgccactaaagtccaggaagctatcaattccctcgggggcagtgtctttcctaagcttaattggagtgccccaagggatgcgtattggatagcaatgaatagttctctgaaatgtaaaaccctcagcgacatctttctgcttttcaagagttccgatttcatcactcgtgacttcactcagccgtttattcattgtactgatgattctccagatccatgtatagaatatgagctcgttctccgaaaatggtgtgaattgattcctggggctgagtttcg

SEQ ID NO: 12276 - DNA, 624 bp, Homo sapiens; identical to SEQ ID NO: 3692

SEQ ID NO: 12277 - DNA, 67 bp, Homo sapiens
taccggtccggaattaattcccgggtcgacgagctcactagtcggcggccgcccttttttttttttt

SEQ ID NO: 12278 - DNA, 171 bp, Homo sapiens
ctctgctgctggccagtgggagtggcacgaggtggggctttgtgccagtaaaaccacaggctggatttgcctgcgggccatggtccctgtctagggcagcaattctcaaccttcttgctctcaggaccccaaagagctttcattgtatctattgatttttaccacattagc

SEQ ID NO: 12279 - DNA, 247 bp, Homo sapiens
  misc_feature 231: n = A,T,C or G
gctgattggagtcagctggaacataccactgcctctagactaaggccagcagatttagcaaatacagactgccccagttcattgaattttagataaatgaaataaatctataaggttaagtatgtccccagaactgcatggaacatgttaatctaaacaatgatttgttgttcacctgaaattcaaatttagctgggtgtcctgtatttcatctggcaaccctacttcagncccaggtgtaaggtac

SEQ ID NO: 12280 - DNA, 50 bp, Homo sapiens
tggtacgcctgcaggtaccggtccggaattcccgggtcgacccagcgtcc

SEQ ID NO: 12281 - DNA, 233 bp, Homo sapiens
cccccccccaggtttaaaaaatttttttttttaaaccccccaaggggggggaaaaaaaggcccccccccccaacttaaaaaaaattttgggttttaaaaaaaaaaggggtttcccctttttggccaaaatttcccccctttaaggacctttgaaccccccccctttggcccccaaaaggggggggattaaagggggaaacccccccccccgggaaaatttttttttttttttt

SEQ ID NO: 12282 - DNA, 498 bp, Homo sapiens
tggtacgcctgcaggtaccggtccggaattcccgggtcgacccacgcgtccggtaagactttaacccatgagatcggacacatatttggactgcgacactgccagtggcttgcatgcctcatgcaaggctccaaccacttggaagaagctgaccggcgccctctaaacctttgccctatctgtttgcacaagttgcagtgtgctgttggcttcagcattgtagaaagatacaaagcactggtgaggtggattgatgatgaatcttctgacacacctggagcaactccagaacacagtcacgaggataatgggaatttaccgaaacccgtggaagcctttaaggaatggaaagagtggataataaaatgcctggcagttctccaaaaatgaggaccttcaaataggagtgattgaaataaataactacttgcatgttatgctttcatttgggtggaatacttcattggaataaactactgatcttgtgctgtgtcaaaa

SEQ ID NO: 12283 - DNA, 244 bp, Homo sapiens; identical to SEQ ID NO: 77
  misc_feature 5, 12, 19, 31, 124, 169, 200: n = A,T,C or G

SEQ ID NO: 12284 - DNA, 617 bp, Homo sapiens
tggtacgcctgcaggtaccggtccggaattcccgggtcgacccacgcgtccggtgggcaagtagttggaaccagagaacagcctgcctgctttgacagttatcccagggagcgtgagaaaatccctgggtctagaatgggaactggagaggaccctgagaggagacgggctgggcggcgacccccacagggctctcgagaacagattctcccctccagtatgggccctggctgtggcccccattcctcaggactgcacagaggaggactggctccggctccgtcgggctcacccttaaccactattcctggctctgcaaaccccagactttgcacacagccccaggctccacacagaaatgtgaacttggcctcagacaggctggcccttcctaggctctaggggctagcggggagtggggagccaagaggtcccatattcctgagtgcaggggtagtccctctcacctgcttcctcagacgactctggaagcttccctctaccaccgggcactgagacgaagctccctgacagccgagactggcagccctccatctggtccgtaccctcgccagaggcccccctacatcaacctcctggcgatgccctggtggagc

SEQ ID NO: 12285 - DNA, 165 bp, Homo sapiens
ggccgcccttttttttttttttaaaaattttaaattttaaaaaaaaaaacggccccaaaaagggggtggggttattttaagtcccttaccggcaaaacgggggggcaggacctttttaattttttctcccttttttttgaaaaaaaaaaccagggggaaaaggtt

SEQ ID NO: 12286 - DNA, 264 bp, Homo sapiens
gaagcctggaacaaagttgcccactcatttaactgcacgccaatagaaggtatgctgtcacaccagttgaagcagcatgtcatcgatggagaaaaaaccattatccagaatcccacagaccagcagaagaaggaccatgaaaaagctgaatttgaggtacatgaagtatatgctgtggatgttctcgtcagctcaggagagggcaaggccaaggatgcaggacagagaaccactatttacaaacgagacccctctaaacagtat

SEQ ID NO: 12287 - DNA, 210 bp, Homo sapiens; identical to SEQ ID NO: 917
  misc_feature 110, 178: n = A,T,C or G

SEQ ID NO: 12288 - DNA, 199 bp, Homo sapiens
  misc_feature 3, 13, 25, 77, 88, 129, 136, 143, 156, 169: n = A,T,C or G
agnatctcagtgnaacaaatatagnggaacagaccggtaatgaccctcatgggatggagcatctcagcctgatgggnagaaaacaggnaccatgaccattcacaacggcatgttcttcagcacggtatnacagagnacaatgnacggctggttaanatcagatcccagnaaaacagtgttctaaagaagacggtggtgg

SEQ ID NO: 12289 - DNA, 84 bp, Homo sapiens; identical to SEQ ID NO: 918
  misc_feature 4, 8, 21, 23, 25, 36, 48, 51, 75, 81: n = A,T,C or G

SEQ ID NO: 12290 - DNA, 133 bp, Homo sapiens
aatgttagagactgcagatggagaaagcatgaatacggaagaatcaaatcaaggatctactccaagtgaccaacagcaaaacaaattacgaagttcatagacgagatttgttcaacactgcaattgtttgtta

SEQ ID NO: 12291 - DNA, 582 bp, Homo sapiens
gataaaggcctcaacttggtagtttactgaaagttcttggacaaatagtccataaaagctgttgacctctaaatgcactatggctggttaaatacagtgaccatccttcttccagctgtaaaggatgaagcgtattaagcattagccaggcagtaataaagctaaatagccatacagcagctctgacaatgttgtgctggatattgcagtttgctttcaaggtgcagatgtaaggatttaaaaaaataataatttggcaccaaataaatatgagtagcatccattggcctattaaatcgagtcaggatttgaagggaattgagtttgagaaatgaataaataaaggcaccttggtgcctgaccccctcaatcatgcgtgtgactttgagcactcacaggtgtgtgcagctactcagcccagggcaggtgggttagcctggggttataccttggccctgggaatagacaccattgggcctttggttttgttgggcttccttttgtctttacactccacacaggtggtagaaatctgagttctaaagcacttttgtgaaatacaagctaagtgagaattctaaa

SEQ ID NO: 12292 - DNA, 526 bp, Homo sapiens
ccaagaattcggcacgaggccaaaagagcatattatagtcaatgaggtttaaggtttcttcggttcagtcatgtggaagttttgctttcctaaaattatagctggatcactttgattggatttgggatattacccaaatgctaatcaaatattaaaaggcaatcttttttgttatgtgattgctacagattactgctcttacagtttgattcttcaaattttcattctcagaagggaatcttaaacccagtttgaagggtaccttgtccacaaccacttttaaattttggctaacttcccaaccttccaccatgttctgggaaaactttttctgctcttatagtatgtatgtattcaggaagtgcaacattattaaactaagcataattcagaagctaagtttcctttcatcaaaatttaatattacgaattgtgcaaagaagtatgttactttgatcagctttattttagagcttctttatcaagttatcatcagtcctcttgaattatttctgaaataagggga

SEQ ID NO: 12293 - DNA, 169 bp, Homo sapiens
acagtgaaacttcttgagatggttacataatgtctaaatctgctggtgtagaagttaataaagtgtagaactgaataactattaaatattagatcaagtttctcatgtttatcttaacgtataacgatttatcttaaagcactgattttcacaaaataacatcagtgtg

SEQ ID NO: 12294 - DNA, 559 bp, Homo sapiens; identical to SEQ ID NO: 3700

SEQ ID NO: 12295 - DNA, 246 bp, Homo sapiens
  misc_feature 20, 98, 105, 123, 198: n = A,T,C or G
ggatattcccagtgccactncagaaaagcaggtaacacaggaaggtgaagatggagatggtgatcttgcagatgaagaggaaggaactgtacaacagnctcaagncagtgtcctgtatgaggntttgcttatgtctgaaggagaagatgatgaggaagatgctgggagtgatgaagaaggagacaatcctttctctgntattcagctgagtgaaagtggaagtgactctgatgtgggatcttgtgg

SEQ ID NO: 12296 - DNA, 301 bp, Homo sapiens
  misc_feature 16, 109: n = A,T,C or G
gcgctcctgcgcggtnatttctgggaaaagccagcttctgtttgcactggtcttcacaactcgttacctggatctttttacttcatttatttcattgtataacacatcnatgaaggttatctaccttgcctgctcctatgccacagtgtacctgatctacctgaaatttaaggcaacctacgatggaaatcatgataccttccgagtggagtttctggtggtccctgtgggaggcctctcatttttagttaatcacgatttctctcctcttgagatcctctggacttctccatctacctgg

SEQ ID NO: 12297 - DNA, 66 bp, Homo sapiens
cccttttttgtttttttctttttggatttcatgtctttgaggaccccttgctaatgatgaaaaaat

SEQ ID NO: 12298 - DNA, 399 bp, Homo sapiens
  misc_feature 8, 87, 109, 354, 385, 390: n = A,T,C or G
agagaggncccaagcaactagcccctcaccccaacatcatccgggttctccgcgccttcacctcttccgtgccgctgctgccagggncctggtcgactaccctgatgtnctgccctcacgcctccaccctgaaggcctgggcatggcggatcgctgttcctcgttatgaagaactatccctgtaccctgcgccagtacctttgtgtgaacacacccagcccccgcctcgccgccatgatgctgctgcagctgctggaaggcgtggaccatctggttcaacagggcatcgcgcacagagacctgaaatccgacaacatccttgtggagctggacccagacggctgcccctggctngttgatcgcagattttggctgctacctgggntgatnagagcatcg

SEQ ID NO: 12299 - DNA, 486 bp, Homo sapiens
  misc_feature 376, 395, 467: n = A,T,C or G
agcctgatctctgtccaccggtcctttataccctcatgacccgctgctgggactacgaccccagtgaccggccccgcttcaccgagctggtgtgcagcctcagtgacgtttatcagatggagaaggacattgccatggagcaagagaggaatgctcgctaccgaacccccaaaatcttggagcccacagccttccaggaacccccacccaagcccagccgacctaagtacagaccccctccgcaaaccaacctcctgggctccaaagctgcagttccaggttcctgagggtctgtgtgccagctctcctgacggcttcaccagccctatgggagtattccattcttcccgttaaattcactggcacaccccacctnttccaccgggcacaatgtntttcaaaacggccacaggatgggggggagggagggattttcattccaacccaggcaggccgaggaagagggnccagcagttgttggggagg

SEQ ID NO: 12300 - DNA, 589 bp, Homo sapiens
  misc_feature 15, 20: n = A,T,C or G
agcccctgccatcgnacctnggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggttgaattcacattccctgactttgtaacagagggagccagggacctcatttcaagactgttgaagcataatcccagccagaggcaactgctcagagaagtacttgaacacccctggatcacagcaaattcatcaaaaccatcaaatttgccaaaacaaagaattcagctagcaaacagtcttaggaatcgtgcagggggagaaatccttgagccagggctggccatataacctgacaggaacatgctactgaagtttattttaccattgactgctgccctcaatctagaacgctacacaagaatatttgttttactcagcaggtgtgccttaacctccctattcagaaagctccacatcataaacatgacactctgaagtgaaagtagccac

SEQ ID NO: 12301 - DNA, 579 bp, Homo sapiens
ggggccgcaccccaatgtcatcaccctgcacgaggtctatgagaacaagacggacgtcatcctgatcttggaactcgttgcaggtggcgagctgtttgacttcttagctgaaaaggaatctttaactgaagaggaagcaactgaatttctcaaacaaattcttaatggtgtttactacctgcactcccttcaaatcgcccactttgatcttaagcctgagaacataatgcttttggatagaaatgtccccaaacctcggatcaagatcattgactttgggttggcccataaaattgactttggaaatgaatttaaaaacatatttgggactccagagtttgtcgctcctgagatagtcaactatgaacctcttggtcttgaggcagatatgtggagtatcggggtaataacctatatcctcctaagtggggcctcccatttcttgagacactaagcaagaaacgttagcaaatgtatccgctgtcaactacgaatttgaggatgaatacttcagtaataccagtgccctagccaaagatttcataagaagacttctggtcaaggatccaaaagaatgac

SEQ ID NO: 12302 - DNA, 789 bp, Homo sapiens; identical to SEQ ID NO: 3703

SEQ ID NO: 12303 - DNA, 747 bp, Homo sapiens
gataatttatgattttattgtctttcctttgtccggcctttaacatgtttctgtaatttaaataaaaatctatttactttctccattttagcaaatggtttctttacccaaataggttgcactatagtccccatatggttttctactgttccacaaccactatttcacaaagattgacaaaactttaataaaagttaaatttacagacatcttaagataacttgggaaatatgtagtaaaaaagaatcgagtccacaaattaagaatattttgctaatatgcccaacaccaatttcagcaaatccaatctacttaactcatatatttaatgtggtaatttttctaacaaaatttaatggggggatgaatgatatattaatgcccttgacaaagatgacatgtgtgattttgttgtgactaagaaaggagagtatgatttctggtggttatgatatcactctggctcatcgaagctcacagaatatgtaaggttctgccacgttcaaagatgttaggcaaatgtaatagaaggcgcaccgggctgacacacgttttcatcatacaaatctttctgcagttcctcttcatctccatcaggaaaattatgtagggaatgggagatttttaccgagatccttaaatggccggcagtttaaaatcttttgacctttacctaagccatttttatggtccaggtccagaccatttaacataggatattggtggggccttggttaattcctccac

SEQ ID NO: 12304 - DNA, 607 bp, Homo sapiens
ccaagaattcggcacgaggcaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgcttt

SEQ ID NO: 12305 - DNA, 472 bp, Homo sapiens; identical to SEQ ID NO: 2515

SEQ ID NO: 12306 - DNA, 495 bp, Homo sapiens
ccaagaattcggcacgagggggtggcacagtgaaatttatttgtctttatgatttacacataataattaaacacacaaaagaaaaaacactgtcaagatggccatatgtagcttaggaaatgactggtcccaatgcaatcatataaatgttcattcagcgtaaaaatgagtttctttttaatggttttaatcttttttttttcagtccccaaggcttgtaccactcagtacaaatgtttttgctactgggttatcatcaggaacatgatgtttaccaattcccaggaaatgaataaaatcaacagaaacatcctgggcatgtaccattgtcactttttgacctctgcctaattgtagggcaaaatcttaggattaaaaatatccaaatattccttcaattcctagtggtttcttggtctccagaatagttaaaaacagagaggaaattagactcaaaagttttgctgccttcttttctttgcatccatcgcatcc

SEQ ID NO: 12307 - DNA, 213 bp, Homo sapiens; identical to SEQ ID NO: 3706
  misc_feature 84: n = A,T,C or G

SEQ ID NO: 12308 - DNA, 211 bp, Homo sapiens
  misc_feature 85, 101, 123: n = A,T,C or G
ctcgagccgaatcggctcgaggcctcggtgatgtcgtgggttcaagcagcctccttgatccagggccctggagacaaaggggacntgtttgacgaagaagnagacgagtcgctcctggcgcangggaatggcagagtaacatgcaaagacgagtcaaagaaggttatagagatggaatagatgctggcaaagcagttactcttcaacaggg

SEQ ID NO: 12309 - DNA, 244 bp, Homo sapiens
  misc_feature 35, 36, 65, 155, 183, 186, 188, 201, 225, 241, 242: n = A,T,C or G
gtgcagacccctgtaactcctgaacctgggcaggnngggaccccgctccccaacacctgtatttncctcaatgctgccaccatgcctgaatgcctgcagcccaggaggcccgcacaccggtacactcgtggacacctacacactccataggagancctggctttccagggtgggcaagggcanggntntggcttggagccngggaccttgggggtgtagggtaanccctgagctgggcctnntt

SEQ ID NO: 12310 - DNA, 353 bp, Homo sapiens; identical to SEQ ID NO: 3708

SEQ ID NO: 12311 - DNA, 238 bp, Homo sapiens
  misc_feature 138: n = A,T,C or G
agaccatggtgagaaaaaccagaagcttgaagaccatgctccaggtccagttcctgttccaggtcccaaaagccatccttctgcatcctcgggcaaactgctgcttccacagtttgggatggtcatcattttaatcantgtttctgctataaatctctttgttgctctgtagtttgatgcattgtttatctttcttattctttacttgaaataactatagggatccacaggagatcaa

SEQ ID NO: 12312 - DNA, 152 bp, Homo sapiens
gccgcccttttttttttttttttttttttttttttttttttttttttttttttttttttcttttttttggggggggaaaaaaaaaaaaaaaaaaaaaaaaaaaaaaggggggggggggcaaaaaaaaaaaaaaaccccgggggggggccaac

SEQ ID NO: 12313 - DNA, 207 bp, Homo sapiens
ggccgcccttttttttttttttttttaaaaaaggaccttttgcttttgggccccaggggggaagcaaagggcttggttttggccaccccaaatttttgcctttggggttaaggcaattcccccccccaaaaaggaaaaaaaggggcggggccggggggtttttcccggtaaagccacttccctcccttttttaaaaaaaaaaccggg

SEQ ID NO: 12314 - DNA, 247 bp, Homo sapiens; identical to SEQ ID NO: 3709

SEQ ID NO: 12315 - DNA, 50 bp, Homo sapiens
aagtttttggatggcagcgatctcaccctggctgactgcgacctgttgcc

SEQ ID NO: 12316 - DNA, 136 bp, Homo sapiens
gagcttgagaaagccctggggatgaagctgccagaaacgaacctctttgaaactgaagaaactcgcaaaattcttgatgatatctgtgtggcaaaagctgttgaatgccctccacctcggaccacagccaggctcc

SEQ ID NO: 12317 - DNA, 611 bp, Homo sapiens
gccagcagcagccctgcggagcccactcagcaaccatgctcagagacagctgcccggctcgagccctgacctcatctccacagccatggctgcagactgctggagaagttctgagcctgacaagggccaagctggtccctggggctgttgccaggctgacgcttatgacccctgccttcagtgcaggccagaacagtatgggtccttagacataccctctgctgagccagtggggaggagccctgacctttccaagtcaccagcacataatcctctcttggaaaacgcccagagttctgagaaaacggaagaaaatgaattcagcggctgtaggtctgagtcatccctcggcacctctcatctcggcacccctccagcgctacctcgaaaaacaaggcctctgcagaagagtggagatgactcctcagaagaggaagaaggggaagtagatagtgaagttgaatttccacgaagacagaggccccatcgctgtatcagcagctgccagtcatattcaacctttagctctgagaatttctctgtgtctgatggagaagagggaaataccagtgaccactcaaacagtcctgatgagttagctgataaacttg

SEQ ID NO: 12318 - DNA, 604 bp, Homo sapiens
  misc_feature 435, 487, 497, 551, 562, 580, 585, 591, 597: n = A,T,C or G
ctttggagccggccccaggcagcgtgtgtcggtcgcctaggctggagaactagtcctcgactcacggtgagggaatggaccgacacgggtattgtaccgctgagggaaaggagcgggactccggacctccaggagtgcaaggatgatgctgaaaggaataacaaggcttatctctaggatccataagttggaccctgggcgttttttacacatggggacccaggctcgccaaagcattgctgctcacctagataaccaggttccagttgagagtccgagagctatttcccgcaccaatgagaatgacccggccaagcatggggatcagcacgagggtcagcactacaacatctccccccaggatttggagactgtatttcccatggcttctctcgtttgtgatgcaggtgaagacattcagtgaacttgctgatngtaaggaaaccagcctagaatttgcattactgaaaacacagtttgctatcantatacgatantttgtatgagagaaggacaggaaaacctaagtctttgcatgttatcattctgtnaaacagactgntgatatacatatcagatnccacnttggtnaaatgncggattt

SEQ ID NO: 12319 - DNA, 593 bp, Homo sapiens; identical to SEQ ID NO: 3710

SEQ ID NO: 12320 - DNA, 346 bp, Homo sapiens; identical to SEQ ID NO: 933
  misc_feature 38, 41, 48, 333: n = A,T,C or G

SEQ ID NO: 12321 - DNA, 624 bp, Homo sapiens
tggccctcgaggccaagaattcggcacgaggataattcctgttccactttctttgatgaaacaagtaaagaagaaacaacacaatcatattaatagaagagtcttcgttccagacgcagtccaggaatcatgctggagaagttctgcaactctactttttggaattcctcattcctggacagtccggaggcagacctgccactttgttttgagcaaactgttctggtgtggattcccttgggcttcctatggctcctggccccctggcagcttctccacgtgtataaatccaggaccaagagatcctctaccaccaaactctatcttgctaagcaggtattcgttggttttcttcttattctagcagccatagagctggcccttgtactcacagaagactctggacaagccacagtccctgctgttcgatataccaatccaagcctctacctaggcacatggctcctggttttgctgatccaatacagcagaacaatggtgtgtacagaaaaactcctggttcctgtccctattctggattctctcgatactctgtggcactttccaatttcagactctgatccggacactcttacagggtgacaattctaatctagcctactc

SEQ ID NO: 12322 - DNA, 403 bp, Homo sapiens
acagatttgacaaataacaaagtctacgccgcaaaaattattcctcacagcagagtagctaaacctcatcaaagggaaaagattgacaaagaaatagagcttcacagaattcttcatcataagcatgtagtgcagttttaccactacgttcgaggacaaagaaaacatttacattctcttggaatactgcagtagaaggtcaatggctcatattttgaaagcaagaaaggtgttgacagagccagaagttcgatactacctcaggcagattgtgtctggactgaaataccttcatgaacaagaaatcttgcacagagatctcaaactagggaacttttttattaatgaagccatggaactaaaagttggggacttcggtctggcagccaggctagaacccttg

SEQ ID NO: 12323 - DNA, 432 bp, Homo sapiens
  misc_feature 400, 408, 414: n = A,T,C or G
ggcaccagtctctagaaaagaagtcagctctggttcggagaagcagcggctggcgtgggcatccggggaatgggcgccctcgtgacctagtgttgcggggcaaaaagggtcttgccggcctcgctcgtgcaggggcgtatctgggcgcctgagcgcgcagtgggagccttgggagccgccgcagcagggggcacacccggaaccggcctgagcgcccgggaccatgaacggggaggccatctgcagcgcccatgcccaccattccctaccacaaactcgccgacctgcgctacctgagccgcggcgactctggacttgtgtcgtccgcccgccacgcagactggcgcgtccaggtggccgtgaagcaccttgcacatccacactccgctgctcgacagtnaaagaaangatgtnttaggagaagctgaaatt

SEQ ID NO: 12324 - DNA, 486 bp, Homo sapiens
tggatcccccgggctgcaggaattcggcacgagctcataaacacagagctttagctccgccaaaatgaaacactcattaaacgcacttctcattttcctcatcataacatctgcgtggggtgggagcaaaggcccgctggatcagctagagaaaggaggggaaactgctcagtctgcagatccccagtgggagcagttaaataacaaaaacctgagcatgcctcttctccctgccgacttccacaaggaaaacaccgtcaccaacgactggattccagagggggaggaggacgacgactatctggacctggagaagatattcagtgaagacgacgactacatcgacatcgtcgacagtctgtcagtttccccgacagactctgatgtgagtgctgggaacatcctccagctttttcatggcaagagccggatccagcgtcttaacatcctcaacgccaagttcgctttcaacctctaccgagtgct

SEQ ID NO: 12325 - DNA, 273 bp, Homo sapiens
  misc_feature 263: n = A,T,C or G
cacacacacaccaaattgaacaaactggaaactctcactctgtgaaaagttgtattctacacatttctgcacagaccacaagcagtgttatttccctgatgtttgagttgttttgttcttttgtgtgttttgtttatttgtgtgttgtttgttggttttcgtttcttgagtttttgttttgttttcaccacatctgttatttccactagtttttttttggctgtgtcatgacaggcctcatgatgctaacagagattcttccnttcttttttc

SEQ ID NO: 12326 - DNA, 519 bp, Homo sapiens; identical to SEQ ID NO: 3717

SEQ ID NO: 12327 - DNA, 248 bp, Homo sapiens
  misc_feature 63, 215: n = A,T,C or G
gcagagttgtcgctactggagaagtccctgggactgagtaaggggaataaatacagtgctcanggcgagcgacagattccagttcttcagacaaacaatggtccaagtctaacaggattgactactatagcagctcatctagtcaagcaagccaacaaagaatatttgctggggagtactgcagaagaaaaagcaatcgttcagcagtggttagnatacagggtcactcaagtagatggggcactcca

SEQ ID NO: 12328 - DNA, 286 bp, Homo sapiens
  misc_feature 24, 47, 49, 120, 279: n = A,T,C or G
aagaaagctggccttcgacatggntaccaatgctgcctgtgcatctntnctgaaaaagaaacagggaacagatgcagttcgaacattaagcaatgccgaggactatctcgatgatgaagnctcagattaattcctttctggagctttgagatctaaaacttctgttgcttttgccattccaaaactttgtctttgccagaaaagtgttggtaactataaaggaaattatatatgaacacggcagtgttgcactgtgtttgagtagaacgtgtaaatganttgttcc

SEQ ID NO: 12329 - DNA, 585 bp, Homo sapiens
aattcctacatatatacttttatttttagtgaccacatttctttgtttcaggtgtaaaattaaaaaatatattgtacacttagcatacttggcctaccaaatcccgtctaagttctgagcacactctctcctcaaaagtatcatattcaacagcattttaaatttagagagagagtttgatgatacaggttttaaaacaaataagcatgtattgaaccaagtgatttaagacaaaatatttcaattgtttacagcttgggtatgagagggaagatgcaaatttaaggtacatttttcttctagctacgatgtatgttttacttacttgaagaccccttaaaaaaagtagcaaaatcagcagtcttgtttaatataatcaaaatattcttaaatgtacaaaaaaggatcatgtagaaagaatactgtaaaaagatactgatcttaagaataaaagattaggaaaagcttctattacattcggcccagccagttacttcggcaaatttccggttctccaggtgtgcgccagggtttcccatccccatagcgcctcggcccagagttcgcgaatgagacacgggctcg

SEQ ID NO: 12330 - DNA, 103 bp, Homo sapiens; identical to SEQ ID NO: 3720

SEQ ID NO: 12331 - DNA, 423 bp, Homo sapiens
gcgaccgcctggtggactccaaagccaagaccgaccggctgtgcgcctacatggcacccgagcgcattgaccccccagaccccaccaagccggactatgacatccgggccgacgtatggagcctgggcatctcgttggtggagctggcaacaggacagtttccctacaagaactgcaagacggactttgaggtcctcaccaaagtcctacaggaagagcccccgcttctgcccggacacatgggcttctcgggggacttccagtccttcgtcaaagactgccttactaaagatcacaggaagagaccaaagtataataagctacttgaacacagcttcatcaagcgcttacgagacgctggaggtggacgtggcgtcctggttcaaggatgtcatggcgaagactgagtcaccgcggactagc

SEQ ID NO: 12332 - DNA, 372 bp, Homo sapiens
ccaagaattcggcacgaggtctttaagtctcttttctcttttttcgcgcaaaaatgccggatccagcgaaatccgctcctgctcccaagaagggctccaaaaaggctgttacgaaagtgcagaagaaggacggcaagaagcgcaagcgcagccgcaaggagagctactccgtttacgtgtacaaggtgctgaagcaggtccaccccgacacagcagcaactccatgcaaaccatccaaaagaaccaccacccgccggatagtggatggcaaagtggtgtctgagaccaatgacaccaaagttctgaggcattaagccagcagaagcagggtaccctttggggagcaggaggccaataaaaagttcagagttc

SEQ ID NO: 12333 - DNA, 582 bp, Homo sapiens
ccaagaattcggcacgaggcttggtttttcatggtccctggcagactgggtttgtagatgaaactgaagctgccaaagtggaacgtgtgaaacaggaaaaaggtattttctgggaaccctttgctaatgtgactgtagaagaagcaaagaggtcatctttacaggtatgggctgatttcaataggggccaaactttaacaaggcaaattctgccctttttacttactgacgaaacaaaccagtgtggtttccagccttatgctgaatttcaaatcaaatagatctagacatgtaaaattctgttttatggtagttgcttttaaaattaagaagtgggactacaccatatcaaatatattctttcagtatgtttgaattattggtagtaacctttaagggaagttacatattgtaccagtgatgctataaatgcagtctttactgaaccacagaagaaaatgaaagaaactacttcctaaatgtttagtttgattccttgccttattaatcaaatgagtctcctaataatttttggcagtaactgaagatcacatctacttattaaaaggcagaacttgacac

SEQ ID NO: 12334 - DNA, 678 bp, Homo sapiens
ggaatttggccctcgaggccaagaattcggcacgagggaagttattatctcgaactgacactgagccacaacccaaacaacccagctctccctaagcttcaaactagactacttctccataatattcatccctgtagcattgttcgttacatggtccatcatagaattctcactgtgatatataaactcagacccaaacattaatcagttcttcaagtatctactcattttcctaattaccatactaatcttagttaccgctaacaacctattccaactgttcatcggctgagagggcgtaggaattatatccttcttgctcatcagttgatgatacgcccgagcagatgccaacacagcagccattcaagcaatcctatacaaccgtatcggcgatatcggtttcatcctcgccttagcatgatttatcctacactccaactcatgagacccacaacaaatagcccttctaaacgctaatccaagcctcaccccactactaggcctcctcctagcagcagcaggcaaatcagcccaataaggtctccacccctgactcccctcagccatagaaggccccaccccagtctcagccctactccactcaagcactatagttgtagcaggaatcttcttactcatccgcttccaccccctagcagaaaatagcccactaat

SEQ ID NO: 12335 - DNA, 511 bp, Homo sapiens
cccagcaacatcctgtatgtggacgagtccgggaatcccgagtgcctgcgcatctgtgactttggttttgccaaacagctgcgggctgagaatgggctcctcatgacaccttgctacacagccaactttgtggcgcctgaggtgctgaagcgccagggctacgatgaaggctgcgacatctggagcctgggcattctgctgtacaccatgctggcaggatatactccatttgccaacggtcccagtgacacaccagaggaaatcctaacccggatcggcagtgggaagtttaccctcagtgggggaaattggaacacagtttcagagacagccaatgacctggtgtccaagatgctacacgtggatccccaccagcgcctcacagctaagcaggttctgcagcatccatgggtcacccagaaagacaagcttccccaaagccagctgtcccaccaggacctacagcttgtgaagggagccatggctgccacgtactccgcactcaacagct

SEQ ID NO: 12336 - DNA, 426 bp, Homo sapiens
ccaagaattcggcacgaggtttttttttttttttttttagggggtcctgccaggaaccgggttttttgggaagggaaaaaaccctaaggaccgggggccccaaaaggttgtgggtttttgaccaaaatttgaaccaaaggaaaaacttcgcccctcttttttcggttttggttttccctcctggaggccttggccctcttttttttttaggcccggaaccacttctggaaagcggcccctctttggtcccccttggaacccaagaacctctgggccctaaccttgaagggggcccttcttttttttgaaacccgggcctttttccaatttttcccgttgttgttgttgcaattaaaaaatattttggggattttggcccatccacttggaaaggggctgttccttttccaaacctttttttttttg

SEQ ID NO: 12337 - DNA, 556 bp, Homo sapiens
ccaagaattcggcacgaggggcacatctacacagatatgtgcatgcttgatggtgcaaagaaactgctgacttccaccaacctcatgctcccgctggctggccatacagagggattcgttgtcatattgaaaaggctctgaaagatgagtttctaattgaagctcactatctcaggttggtgtttctactgtgtagtcccaagcctgtatccatatcataaaagtggaggcctggtactcctccaggttatctggccagtgtagactcctccatctgaatatgaacctccagggtaagaattgttcagacatgtctatactgaacagtacgatcctgcactttccaaatgtctgcctccttttgttcttcattgaaccattctaattcctgttaagtgtgagaagaattgtcttcagttctctctccattctcattcatgatggaatcattgatccattgaccagttgagaaatgattgatgctgaagaagtggtattctattggtaaggcttattaccaaacttccgataatgaagcacgctaccaaaaacttat

SEQ ID NO: 12338 - DNA, 543 bp, Homo sapiens
aaaggattatgtgctacaaaattgagtgccagttcagaggacatttctgagagactggccagcatttcagtaggaccttctagttcaacaacaacaacaacaacaacagagcaaccaaagccaatggttcaaacaaaaggcagaccccacagtcagtgtttgaactcctctcctttatctcatcattcccaattaatgtttccagccttgtcaaccccttcttcttctaccccatctgtaccagctggcactgcaacagatgtctctaagcatagacttcagggattcattccctgcagaataccttctgcatctcctcaaacacagcgcaagttttctctacaattccacagaaactgtcctgaaaacaaagactcagataaactttccccagtctttactcagtcaagacccttgccctccagtaacatacacaggccaaagccatctcgacctaccccaggtaatacaagtaaacagggagatccctcaaaaaatagcatgacacttgatctgaacagtagttccaaatgtgatgacagc

SEQ ID NO: 12339 - DNA, 117 bp, Homo sapiens
cacgtacatacatgatgatggcttgagtcagctgcagggcagtgggcttaatgagagggatctttgtaaagacagctcttcacttcagctcagtagctttggtcataggcaagtttg

SEQ ID NO: 12340 - DNA, 51 bp, Homo sapiens; identical to SEQ ID NO: 3722

SEQ ID NO: 12341 - DNA, 413 bp, Homo sapiens; identical to SEQ ID NO: 3723

SEQ ID NO: 12342 - DNA, 227 bp, Homo sapiens; identical to SEQ ID NO: 3724

SEQ ID NO: 12343 - DNA, 448 bp, Homo sapiens
gcctgcaggtaccggtccggaattcccgggtcgacccacgcgtccgcttcccgacaagtggcagcacgatcttttcgacagtggcttcggcggtggtgccggcgtggagacaggtgggaaactgctggtgtccaatctggattttggagtctcagacgccgatattcaggaactctttgctgaatttggaacgctgaagaaggcggctgtgcactatgatcgctctggtcgcagcttaggaacagcagacgtgcactttgagcggaaggcagatgccctgaaggccatgaagcagtacaacggcgtccctctggatggccgccccatgaacattcagcttgtcacgtcacagattgacgcacagcggaggcctgcacagagcgtaaacagaggtggcatgactagaaaccgtggcgctggaggttttggtggtggtggaggcacccgg

SEQ ID NO: 12344 - DNA, 247 bp, Homo sapiens
  misc_feature 68, 100, 169: n = A,T,C or G
aaacagctggacgacctgaaggtggagctgtcccagctgcgcgtcgccaaagtgacaggcggtgcggnctccaagctctctaagatccgagtcgtccggnaatccattgcccgtgttctcacagttattaaccagactcagaacctgaagaccaagaagcagcagcggnaggagcggctgtacccgctgaggaagtacgcggtcaaggcctgaggggcgcattgtcaataaagcacagctggctgag

SEQ ID NO: 12345 - DNA, 92 bp, Homo sapiens
ctccagcccaagatgattccagcagtggtcttgctcttactccttttggttgaacaagcagcggccctgggagagcctcagctctgctatat

SEQ ID NO: 12346 - DNA, 184 bp, Homo sapiens
ggccgccctttttttttttttttctttggaaattggttttttaacgggggggttaaaaggggaaggaaaaaaaaattttggggaaaagccctcaataccccattttccccccggggttttttttccaaatggaacaagggaaggtaaacctgggggaagggaattttaaggggggccctttttt

SEQ ID NO: 12347 - DNA, 177 bp, Homo sapiens
aaaaaggagtccatccacagcatccaaggatccatagtgtcccctcacactgcagccaccaatggaggctactcccgaaagaaagatggtggcttcttctccacctagtgttgacagatccctgaactaattatagtgaaacatactgcggcccacttccattaaatagatttgtgc

SEQ ID NO: 12348 - DNA, 267 bp, Homo sapiens
gcttggtaactactttcctctgccaggctatgggaaagaggatgtaattgtgaataatatacaccatccagtctttaatgtgctgcaacaatgtagtaatttgtttttttcatttgttcccactgcctttgtgtacatagaaaacttaaaaatttcccccagtctattagaagttaagatgttccctaatttattaaatatgcctttattcacaatttgtttttttaggttattcttaatgcattatagaattaagtatgactttgt

SEQ ID NO: 12349 - DNA, 373 bp, Homo sapiens
ggccgccctttttttttttttaaaaaaaaaaccccttttttttttttccccttttagggggggaaaaaaaaccccttttttaatggaaaaaggggggacccgggtttccccttttttttaaagttttaaaaaccccccttgaaaaccccccccggggggttttaaaaacccccccaagaatttcaacccccgttttccgtttacttttccaagggggtaaaacccaaattttttttccccttttccttcctcggggcttttttatttttttccgtttttttttaaagggctttggaaaaccccggggcaatttttggggaaaacctttttttgggggaaaaaaaaaggtttgggccccccttttaggggggtt

SEQ ID NO: 12350 - DNA, 239 bp, Homo sapiens
  misc_feature 73, 117, 208, 211, 221: n = A,T,C or G
tgcctcctcgctggccgcgctccctcccggtgccggcttctctgagtcaccaacctgaggctgccccggccgnctgcgcacccggcagcaccatgacagatcaggcctttgtgacantaaccacaaacgatgcctacggcaaaggtgccctggtcctgggatcatctttgaaacagcacaggaccaccaggaggctggtcgtgcttgncancccttaggtnttagacttcatgagaaaa

SEQ ID NO: 12351 - DNA, 217 bp, Homo sapiens
  misc_feature 10, 14, 35, 52, 59, 126, 154, 187, 201: n = A,T,C or G
gataattgangatntcctaagcccagatacctgtntatgtgggacagatganggccgantcctggaagcctgagggaagacatgctggagaccctggttcccaaggcagagggtgaccgtttgatngtggtgctgggcccacagactggaaggntgggacatttgctgagccgggacagagcacggngccgggctttggtncaactgccaagagaaa

SEQ ID NO: 12352 - DNA, 266 bp, Homo sapiens; identical to SEQ ID NO: 944
  misc_feature 25, 37, 169, 186, 225, 244, 252, 264: n = A,T,C or G

SEQ ID NO: 12353 - DNA, 522 bp, Homo sapiens
aaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatg

SEQ ID NO: 12354 - DNA, 499 bp, Homo sapiens
ataaagctcagtggtggtgttacctcaccggggaccagggtcacacagcaaagctggaacaacagaggcgtgttgtgggggagcctcagaggggacaaaacctctgcctgagatcccaccccaggtgggcatgggggccactgaggttggggatgaaaatgccggtaccgtcagtgcacagccctgttccagacagtgctgcctggaagatttctgggctctcctgaggcgccaccccgcacctgagccacctccttggactcctgtcctctaccccttgaggacctccctcccttctaccctagctgtcttcttgaacttgggactctcctttcccaagacttccatcactagctcctggagggactggactttgcatcttcccttcgcgtggagcctcagtgtgagaggccctagccaatgcgtgcatgtcagaggtggtggggaccacatcagaagaagaggggggtgatgaaattaacaaataaaaagtatgggg

SEQ ID NO: 12355 - DNA, 255 bp, Homo sapiens
  misc_feature 72: n = A,T,C or G
tcctgaagatcgcagactttggactctgcaaggaagggatcggcttcggggaccggactagcaccttctgtngcaccccggagttcctggctcccgaggtgctgacccaggaggcatacacacgggctgtggactggtgggggctgggtgtgctgctctacgagatgctggtgggtgagtgcccgttcccaggggacacagaggaagaggtgtttgactgcatcgtcaacatggacgccccctaccccggcttat

SEQ ID NO: 12356 - DNA, 466 bp, Homo sapiens; identical to SEQ ID NO: 3725
  misc_feature 4, 75, 79, 450: n = A,T,C or G

SEQ ID NO: 12357 - DNA, 463 bp, Homo sapiens; identical to SEQ ID NO: 3726

SEQ ID NO: 12358 - DNA, 399 bp, Homo sapiens
aagaattcggcacgaggaaaatttcactgagttttagttcattcttctttctctgaaaggagaggaaatcgcctccaggaaccagttccttaatgacgtagataggccgtctttgtgtgtgaactcctatacttttgacattactgggatgattatattgcttgaggattttggcttctagtaaaaattttaatttcagttcctggggaagacgttcttgacgtgttttaacagcaacagcaattttatcctttaatgtgaccttaaatgtgtcaccaaaatttcccttgcctcttgtaacgtggcacctttatgattgagaacccatttcttattctcctaatggccatactgtgataccatgatgctcttaattggaacattgactttttttttttt

SEQ ID NO: 12359 - DNA, 359 bp, Homo sapiens
agggaatttggccctcgaggccaagaattcggcacgaggaattattaaagatcttttttttttttctttttaatccatttaatttaaaaattttcatttggaactactttaaagcttacaaaattttttttaaaaaaatcaagatttcctattttttcttaacccagttttttgactgctaacaccatttttaagagtccagttcctcactttgggaaatggatccagaattagttccttacctacagaccttatttacatatttggtccagggtcccactaaggttttttacctgggatcaaaatcggggtcacatatggcatttatcggctacatttctttagttttctttattcgg

SEQ ID NO: 12360 - DNA, 585 bp, Homo sapiens
taccggtccggaattcccgggtcgacccacgcgtccggtttcgtcatgttgcctaggctggcctcaaactcctggcctcaagcgatcctcccacctcggcctcccaaagtgttgggattacaggcatgagtcaccatgcccaggctaaagctgttatttcctcataacctttactgcacatgttttaaaacaggtccttatcattgtttgccccagcaactggaatagctttctatctgctttcaatcttaacccagtctcaccagggcatataatctttctagaatgcaaatctgatcattttacttgaaggcttaagttttgcagtgacatactttagagcagcactgtctgataggaatagaatgttagcttcatgtatacagatgctccttgacttaggatgggtttatgtcccaataaatccaccataagttgaaaatattgtaagtaaaaaatgcatgaaatacacataccctactgaatatcatagcttagccaagcctaccttaaatgtgctcagaacactgatgttaacctacagttgggaaaaatcatcttacacaaaccctattttataataaa

SEQ ID NO: 12361 - DNA, 465 bp, Homo sapiens; identical to SEQ ID NO: 946

SEQ ID NO: 12362 - DNA, 273 bp, Homo sapiens
aaaaataagatgaagttagacaactttagattttgtgtggtgtgtacatctatgtgcacagtatgtaaattatcttttattgtattgcttaatagaataaagaagtagaaatttaattcctgtgtgtctatacaatattatagcacatcataaacttaaaaccttatttaaatattcctttctgaattctttcctgtaatcatacatgtatcatcaggtatttgacttgtgctggagtttgaatttgtgatatctgtattctgtagttttatc

SEQ ID NO: 12363 - DNA, 144 bp, Homo sapiens
ggacttacggatgtctccccagaaacaaccaccccggagcccccgtcttccgctgcagtttccccgggaacagaggaacctgctggcgacaccaagaaaaaaattgacattttgctaaaggctgtgggagacactcctattatg

SEQ ID NO: 12364 - DNA, 102 bp, Homo sapiens
gcttccccaactaaagcctagaagagcttctgaggcgctgctttgtcaaaaggaagtctctaggttctgagctctggctttgccttggctttgccagggctc

SEQ ID NO: 12365 - DNA, 335 bp, Homo sapiens
  misc_feature 20, 21, 41, 53, 78, 153, 188, 222, 229, 238, 257, 260, 266,278, 302, 320, 329: n = A,T,C or G
tctcagaggcagcgtgcggnngtgctctttgtgaaattccnccatggcgtacngtggccagggtcagaaagtgcaganggttatggtgcagcccatcaacctcatcttcagatacttacaaaatagatcgcggattcaggtgtggctctatgngcaagtgaatatgcggatagaaggctgtatcattngttttgatgagtatatgaaccttgtattagatgntgcagangagattcanttctaaaacaaagtcatgnaancaactnggtcgggtcatnctaaaaggagatactattactctnctacaaagtgtctccaantagaaatgntcactg

SEQ ID NO: 12366 - DNA, 405 bp, Homo sapiens
aaaaaagagtaaatcaaaaaaagggaaacatcacaaaaaggaaaaaaagaagagaaaaaaggaaaagcattcttctacacctaatagttctgaattctccagaaagtaactgagactttggcttaagccgttaaatttaaaaatttgtttttaaaacgtgtttgcccttccttggaatttgctatatattatgctttgcaataaatcacagccttttccatatagacatttttcgtatttgggaccattatccctctggcaatatatttttaatgtgctgtaactgtaaagtattaaatcagtcttgttacttgatagccatgccccaagtatagctatttgtgtatactaaacacatcatttttggtatttgtgtctctgtgtgtttggctagtgttactactt

SEQ ID NO: 12367 - DNA, 650 bp, Homo sapiens; identical to SEQ ID NO: 950
  misc_feature 637: n = A,T,C or G

SEQ ID NO: 12368 - DNA, 358 bp, Homo sapiens
  misc_feature 287: n = A,T,C or G
ggcaacctaggtgtccgcgggatggcgctcttcttctactctcatgcctgcaaccggatttgcgagacatggggccttgctccctttgacctctcgccccgggagagggatgcagtgaatcagaacaccaagctgctgcaatcagccaagaccatcttgagaggaacagaggaaaaatgtgggagcccccgagtaaggaccctctctgggagccggccacccctgctccgtcccctttcagagaatctgggagacgagaacatgagcgacgtgaccttcggattctnttcccttctttccccatctttgggccacaccacacaggccaggaagctaggaccacttccattgggccatt

SEQ ID NO: 12369 - DNA, 495 bp, Homo sapiens
  misc_feature 6: n = A,T,C or G
gagatngatgaataagaagtgacattgagctgacccggcagttctgtttgaactcaaacatatgagagatgttcagttcaaccatctcactcgcttcattggcgcctgcatagaccctcccaacatttgcattgtcactgaatactgtcctcgtgggagtttacaggatattctagaaaatgacagcatcaacttggactggatgtttcgttattcactcattaatgaccttgttaagggcatggcctttctccacaacagcattatttcatcgcatgggagtctcaagtcctccaactgtgtggtggatagtcgttttgtgctcaaaatcacagactatggcctggccagcttccgatgcaactgctgaacctgatgacagccatgccctctatggccaaggaagctgtgggactgccccaggaactggctcagtggggaaccccttggccaaccacagggctggcagaagggttgacgtctattaggtttggt

SEQ ID NO: 12370 - DNA, 483 bp, Homo sapiens
  misc_feature 10, 424, 435, 452: n = A,T,C or G
actgtgaagnttagtgtggagaggagttaataagctgggtgacagaaatgctgggtcttggtcctttaaagacaaggattcctgagctgttttaaccagtgcctgagttggagtcctttgggggaaaagctatgtggggactgaagaatggactcattcataactaatgaaagggacagcctggcccctagatgtctgtgaggcctgtcatatggtgataaatgcacttttgtcatatggtgatacatgtaggccccagaggtgatccgaatgcaggataacaacccattcagtttccagtcggatgtctactcctatgggcatcgtattgtatgaactgatgacggggggagcttccttattcttcacatcaacaaccgagatcaggtaagtctgtgctgggtgcgaaaggacccaactcgtngggagcccctngggccttccgccagccntaagcagctagaagggttagggatttgttat

SEQ ID NO: 12371 - DNA, 580 bp, Homo sapiens
ggccctcgaggccaagaattcggcacgagggagaaaatagcacctcacttccagaaagctttaagacaaaagctggagtcccaaataaaccaggcattcccaaattactagaagggagtaaaaattcaatacagtgggagaaagctgaagataatggatgtagaattacatactatatccttgagataagggactgaaaacacaccgtcgatgaaaaccagccactgatgaacagcctcagacctggccagtacggggagcacgtgaaccataactggcttagaaggactgatttcatgccaacttgaggggagaattccaaattccaaagacactcctctcacaggactatgaaaccatcttttaagaagttccaaggacaaaagtcacttccataattatagtcctggcaacttgatctttagatctatttttgcttcatctggctctggcattcccataaccttaaaaaatgttcctgttcatactagagaattcccttggcccttatttctaattgaaacctccttgaagtttctgttgctgcttttcatgcagagtgaaatacattctaacctgc

SEQ ID NO: 12372 - DNA, 400 bp, Homo sapiens
  misc_feature 263, 291, 349, 395: n = A,T,C or G
ttatgaaaacaaaaaatatttgtacctggtgctagaacacgtgtcaggtggtgagctcttcgactacctggtgaagaaggggaggctgacgctaaggaggctcggaagttcttccggcagatcatctctgcgctggacttctgccacagccactccatatgccacagggatctgaaacctgaaaacctcctgctggacgagaagaacaacatccgcatcgcagactttggcatggcgtccctgcaggttggcgacactgtttngggagaccagctgtgggtccccccactnacgcctgccccgaggtgatccggggggagaaagtattgacgggccggaagggaacgtngtgggagcttgcggcttcattcctgtttcgccttgctggtgggggnttgcc

SEQ ID NO: 12373 - DNA, 451 bp, Homo sapiens
  misc_feature 433, 447: n = A,T,C or G
aactgtacaaaataatttaatgtttacaaaaatattagaatgtttagttgactgacacagtcttaagtaatctcttctagagaagtatatagtaagaccactgattcccatttcatttcttttttaataagtcaaagaaaggatgctgcaatgcttcatccaaggtaattctttgagttggatcatattctaacattcttcgaaccaggtcaaacagtttctcatgttcttcatcatgacaaagcataaattccttcaacggtttgcagcgtctcctaacatatctaccaggcaggaactgtgttcatcccaatctaggctgggttatgggtgaaaatacttgcgttttcttgttttctggaatcatgtgttgtgggtatggggtcctaatatttcgttcccttcattggccggggggctctttaactatccnggaggtctaaaacntgta

SEQ ID NO: 12374 - DNA, 543 bp, Homo sapiens
agaattcggcacgagggtaatcccagataaaataccttctttgaataccatgttaattcggggtaagcaaatgttctcaaataggagttgacacttacccttctactgcagtattccaagagaatgtaaatgttttctttgtcctcgaagtagtggtaaaactgcactacatgcttatgatgaagaattctgtgaagctctatttctttgtcaatcttttccctttgatgaggtttagctactctgctgtgaggaataatttttgcggcgtagactttgttatttgtcaaatctgtcatctcgtaacattttgcaaagccaccctttcccagcactttgccccggcagtagcgcttcccagtcgtggggtcgacgataatccgcgagatctccggccccgagtgcgaatggtggtgatggtggtgaggggccgccgggggcacttgcgcctgggactgaggtggctgcgattcctcggggggctgcggcggccgcaagcttattccctttagtgagggttaattttagcttggcactggccgt

SEQ ID NO: 12375 - DNA, 479 bp, Homo sapiens
  misc_feature 456: n = A,T,C or G
aaagtgacacaaaagttttatgatcagtaacactccatgtctccagaattatatccctaggaggtggaatgccaaaaaacatttctgttttgaacaccatgatacacagcagaaggaggggggaaaaacacgtagatattgcccttcggcttaaaatccagtcctgctcaaatgacatcacttaaaatacccttgatggagctcaaagctggtcctttcttccaagatgggatgcctgggaacaatgattccttcccaataatcctagtgcagtgtcatttgtacagtgggtttccttaagaggtcctgggtgcagagatgtcagcagtatttctgatcagggcccatagggcatgccagacatggggcatggggggtttcatgtttcatctggtccccatgtggaccacttgcttgccctttcatggtggcaccatacttttacacttgcagggnttccctggggtggggggcaactt

SEQ ID NO: 12376 - DNA, 664 bp, Homo sapiens; identical to SEQ ID NO: 954

SEQ ID NO: 12377 - DNA, 62 bp, Homo sapiens
tattttatcggggccagctcaaccatttaaagtatttgccaaataaagaatgcatttaggtt

SEQ ID NO: 12378 - DNA, 424 bp, Homo sapiens; identical to SEQ ID NO: 3734

SEQ ID NO: 12379 - DNA, 598 bp, Homo sapiens; identical to SEQ ID NO: 3736

SEQ ID NO: 12380 - DNA, 214 bp, Homo sapiens
aaaatacttctacagtgacaaagaaaaatcaagaacaaagctttttgatatgtgcaacaaatttagaggaagtaaaaagataaatgtgatgattggtcaagaaattatccagttatttacaaggccactgatattttaaacgtccaaaagtttgtttaaatgggctgttaccgctgagaatgatgaggatgagaatgatggttgaaggttacat

SEQ ID NO: 12381 - DNA, 247 bp, Homo sapiens
gggaggtggtcagtgggacttagggatctttcacctgctgtgcccagtagttctgaagtctgcttgtggagcagtgttttatgtttatccctgtttactgaagaccaaatactggtttggagacaacttccatgtcttgctcttctacctccctagttagtggaaatttggataagggaactgtagggcccagattctggaggttttatgtcattggccacagaataactgtctctaagctatccat

SEQ ID NO: 12382 - DNA, 212 bp, Homo sapiens
  misc_feature 9, 44, 94: n = A,T,C or G
ctgggattngggggtgcagtcctgggggtggggctcagcctggnccctgtccccctcactccctgggtgtttggggtcactgctggggtcttcntctatgtggcccttgtggacatgctaccagccctgcttcgtcctccggagcccctgcctacgccccatgtgctcctgcaggggctggggctgctgctggggggcggcctcatgcttgc

SEQ ID NO: 12383 - DNA, 480 bp, Homo sapiens
ggcggcggcggcggagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagataaaggaaaatttgaagatatggcaaaagcggacaaggcccgttatgaaagagaaatgaaaacctatatccctcccaaaggggagacaaaaaagaagttcagggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgc

SEQ ID NO: 12384 - DNA, 392 bp, Homo sapiens
gaaactcacagagaaaaaaaactaatacaaaacactgaaaagagcatcaaggggccgggcacagtggctcacgcctgtaatcccagcactttgggaggctgaggtgggtgtatcacctgagtgcaggattttgagaccagcctggccaacatgacaaaaccccatctatactaaaaatacaaaaattcaccaggcttggtggcaggcgactgtagttccagctactgaagaggctgacgcatgataatcacttgaacctgggaggaggaggctgcagtgagctgagatggcaccactgtactgcagcctgggtgacagaccaagactccatctcaaaaaaaaaaactccatctaaaaaaaaaggcggccttttttaaaaaaccccccccttt

SEQ ID NO: 12385 - DNA, 437 bp, Homo sapiens
gcttctctcttcctcggcgctgcctacggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgc

SEQ ID NO: 12386 - DNA, 504 bp, Homo sapiens
agagtctcactcagtcacccaggctggagtgcagtggtgcaatctcggctcactgcaagctctgcctcctgggttcacgccattctcctgcttcagcctcccgagtagctgggactacaggtgcccactaccacgcccagctaattttttgtatttttagtagagacagtgtttcaccgtgttagctaggatggtcttgatctcctgacctcgtgatccacccaccttggcctcccaaagtgctgggattacaggcgtgagccaccgcgcccagccaggaagacattttagtaaccttagcatcattcttttctgccaggatccagaagcaccgtccttgtacctacataaggaaaatacactgctgggacccagcaaggtatagatcaggggtgtccaatcttttggcttccctgggccacattggaagaagaagaattgtcttgggccacacataaaatactaatgatagctgatgagatagaagaaaaatcaccaaaaaat

SEQ ID NO: 12387 - DNA, 377 bp, Homo sapiens
attttgttcagatgttgactctccgggggcactggctcattccaagactgttcttgtgcaactctcagaataccttatttgagcatacctgttttgaaaggcattttctttttatagttaggtgtagtgcttaagggttaatttattttcatgttatgccagtaatatagtgttgtatgcctattgagtgattgtggcaagaaaagctacagcttctttgcgtttaactttttcaaaccacagaccagaactggttgcatgttactttaggagttgtgggttggtaagctcccacgtacttcccgaggctatggtgtgagatcccccgtcctgccctttggggctccacaggcccctggcaaggcccgtggcttaag

SEQ ID NO: 12388 - DNA, 178 bp, Homo sapiens
cagaaggggaagaggtggggaggaagaggaggaggaagaagaaggtgatggtgaggaagaggatggagatgaagatgaggaagctgagtcagctacgggcaagcgggcagctgaagatgatgaggatgacgatgtcgataccaagaagcagaagaccgacgaggatgactagacagcc

SEQ ID NO: 12389 - DNA, 410 bp, Homo sapiens
gagacacagtctcactccatcgcccaggctggagtgcagtgatacaatcttggctcactgcaacctccacttcccaggttcaagtgattctgcctaagcctcctgagtagctgggattacaggcgtgcgccaccacacccagctaatttttgtatttttagtagagacagggtttcaccacgttggccaggctggtctcaaactcctgacatcaagtgatccacctgcctcttcctcccaaagtgctgggattacaggcgtgagccaccatgcccggcctaaaatcattttattgaatatgaagtttagctttcatttcatttatcccccaagagtttcttattctctatttggtcatttttcatatcattttactcttatcctctagatgcagtatcttatatctctca

SEQ ID NO: 12390 - DNA, 53 bp, Homo sapiens
atgcctcatggactctgctaaaaaaaaaaaaaaaaaaaaaaaaaagggttttt

SEQ ID NO: 12391 - DNA, 426 bp, Homo sapiens
gaatttggccctcgaggccaagaattcggcacgaggtttttttttttttaaaaaaatcctctagggaacacagtcaaaagagatttcaatggggggcattctcttggtttgggggggaacaagtattttgggctgctgaaaaagagtgccctgccccacaggggagaccctttctttaccctaataggggggatccagttttttttataaatgggactctcccaggtcccacaaaacaataattttttttgaacaatgggcacatgagagggtttttggcatttaaaccgggaaaaggcggggctggaggggaaaaaaaaatatttaacccttggatgaccggaaaaatatagggctggaaacccattttaaagggtacttttcttttagggacatataactgcacagctgaaaataaagggggaa

SEQ ID NO: 12392 - DNA, 306 bp, Homo sapiens
gctcagcaaggggtggaccactgcccaggggctgggcagaaggccgttgtccagctggccgagaccacccaagagaccatcgacaagactgctggccaggcctatgacaccttcgtctgggcattgggaaaaaattcggcctcctgaagatgacagcagggagacttgggtcggcctactgaaatgacagcagggagacttgggtgaccccccttccaggcgccatctagcacagcctggccctgatctccgggcagccaccaccttctcgggctgccccctcattaaaattcacgttcccaaaac

SEQ ID NO: 12393 - DNA, 656 bp, Homo sapiens
  misc_feature 8, 54, 532, 545, 561, 588, 597, 622: n = A,T,C or G
gccagggntcttgggccttcagccacagactgaaggctgtactgtcagcttccntacttttgagattttgggacacgtactggcttcctggctcctcagcttgcagacggcctatcatggtacttcaccttgtgatcatgaccactggtatagcttgcctggtggtggacttggaggataccattgcattagggcatttctccacatgatagctcctgcctgctggacaggtcgtctcttgactatgtgtattctccagagaagcagataatggctcttgtaggaatgaggcttttaggcacttggctgaatgtggatctcatctccttgcacctgggctgtgctgcacagaattcccacaaagactttcacagaaaagaaatacctcaggttgtactgctggcatatttggtttcccatcaaggtccttaacatttataaaaattggattaaaataactaacgaattaaatatgaatatgaaaataaacagctgttttcatggaaattgcattgatgtggatcctctgaangcatgtccctaangaacctgccaacaaantctgtaaagccgaatggacattctggnaatttatgncctgtgtagaagctagaaaaaaaangggagaaaaagaactctcagcctgaggcctacgt

SEQ ID NO: 12394 - DNA, 534 bp, Homo sapiens; identical to SEQ ID NO: 964

SEQ ID NO: 12395 - DNA, 508 bp, Homo sapiens
atctacacccaccatagtgatgtgtggtctttccgggtgctcctgtgggagatcttcactctgggcggctccccataccccggtgtgcctgtggaggaacttttcaagctgctgaatgagggtcaccgcatggacaagcccaggggctgcaccaactagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgct

SEQ ID NO: 12396 - DNA, 444 bp, Homo sapiens
ggtccacagggtaagcttctctgccagtgggagccggctggcctgggtcaaccacgacagcaccgtgtctgttgctgatgcctcaaaaagtgtgcaggtctcgactctgaacacagagttcctagccgctcctaagtgtgtcattcgtctcagagaacagcgtcttggctgctgaccatgactgctgcccaatgctctttaactacgatgaccgcagctgcctgaccttcgtctccaagttagatattccaaaacagagcatccaacgcaacatgtctgccatggaacgcttccgcagcatggacaagagagccacaactgaggaccgcaacactgtcttggagacgctgcaccagaatagcatcactcaagtctctatttatgaggtggacaaacaagattgacgtagattttgcactactggcatcgatggagccatgataa

SEQ ID NO: 12397 - DNA, 282 bp, Homo sapiens
attctaagaaaatggacctgacagtaaatggggaacaactggatctggatcctggtcaaactttaatttattatgttgatgaaaaagcacctgaattctcaatgcagggtctaaaagctggtgttattgctgttattgtggttgtggtgatagcagttgttgctggaattgttgtgctggttatttccagaaagaagagaatggcaaagtatgagaaggctgagataaaggagatgggtgagatgcatagggaactcaatgcataactatataatttgaaga

SEQ ID NO: 12398 - DNA, 99 bp, Homo sapiens
gagccagcctgacattagacagaataccctttgttatacatagtacatttttactcatgccttattgtttaggataaataggtaagcacaaagagctct

SEQ ID NO: 12399 - DNA, 424 bp, Homo sapiens
gggagggttttcaggcagaggaacagttggccaaggaagtcagcttctcagagctcaagagtagatctgagtttaactcattaaagatggcatggaagagcagtgtcataatgcaaatgggaagatttcttctcttagtaattttatttctgccacgtgagatgacaagttctgttttaactgtgaatggtaaaactgagaactatatcctggatactacacctggctcccaagcatctctgatatgtgctgttcaaaaccacaccagagaggaagaactgctctggtaccgagaggaggggagagtggatttgaaatctggaaacaaaatcaattccagctctgtctgtgtctcttccatcagtgaaaatgacaacggaatcagctttacctgcaggctggggagggatcagtccgtgtccgt

SEQ ID NO: 12400 - DNA, 328 bp, Homo sapiens
gagaagacgacagaagggtaaaatgatcagctctttggggaatctggaatcctttaccctagtcccagatccccagcctctatgttttgtgatagtgccatagctgaggcagacctacagcagtgtagccagtagtttctctaggccttgtaagcccacggttctcaaaatgtggccccagaccaccagcatcagtatcacctggcacaggccaactacttgggagactggggcgggagaactgcccgagcctgggaggtcaaggttgcagtgagccatgatcatgccactgcactccagcctgagtgacagagtgagaccctatccc

SEQ ID NO: 12401 - DNA, 341 bp, Homo sapiens
ggtcgacgagcggtgacctcagccagtgtcacaaggagcagaagagacatccagctgagccctttaaaaattcctgacccacaagcaggactgaatcacttaacgttgtcttgcttgagtgctttgacccgccatctcctcctcctaccaactcttaattccgaggcaagagaagcctcccaagaggaggccactagtagcagagctgaaacaaaagcctcagaagcagtggggaagcattttacctgcagctctggaaaacgacctactgaagaaagtttcagatggggaaacatttagatttgacctaaatggggaaaaaaagtttataatagaaggac

SEQ ID NO: 12402 - DNA, 136 bp, Homo sapiens
ggctaagcggcggatgcagtacaaccggcgctttgtcaacgttgtgcccacctttggcaagaagaagggccccaatgccaactcttaagtcttttgtaattctggctttctctaataaaaaagccacttagttcag

SEQ ID NO: 12403 - DNA, 139 bp, Homo sapiens
ggactggagagaaacagtaggaaggaactttacttttcatcattgtataactcaagtgtttaccaaaaaaaggtaaatgactaggaaacttaatattatagattaaaaaaatataaacagccctagagtacagtacaag

SEQ ID NO: 12404 - DNA, 217 bp, Homo sapiens
gtggagaatgtgtatttactcactgtgaaaacagcaaagcctcattaactagaaactagccccgggagagggcttgatttgtttaaaaagtccccatgatgcccagagctgtgcaaacatttttaagtgggagaggaggaccactaacatttactgagaggtcactctgggccagccactgttctaactgctttacatgtattatttaactttagtt

SEQ ID NO: 12405 - DNA, 146 bp, Homo sapiens
agaagggcagtgtatggaggaatggtaagtactttacagctgttgtacagggcagcatgtcctgaaaggggctgcaagaaatgctgattccaagggatgtgtgccagttctctgggggaggaagaaaggctctgtagcagaaagac

SEQ ID NO: 12406 - DNA, 95 bp, Homo sapiens
gttttatctacgaagcttaataaaggtgtcgttccaattttctataaaacacttgcttccaatgaatcctcaattcggggtcaaatgctcccagt

SEQ ID NO: 12407 - DNA, 196 bp, Homo sapiens
cagaaggggcctttcctcagctgccgacaaggtgctcggtccttccgaggaagctaaggctgcgttggggtgaggccctcacttcatccggcgactaccaccgcgtgcgggggggccaaccctacactcccccgcgccatggcctctgtctccgagctcggctgcatctactcggccctcattctgcacgacgatg

SEQ ID NO: 12408 - DNA, 522 bp, Homo sapiens
gggtaaataaatacatatgcatagactgtaaaaccagcaaagtaagccttactcaaatgttggtataagataaaagtaaggctggacatggtggttcacacctataatttcaactttgggaggccaaagcagaacgatcacttgatgccaagagtttgagaccatcctgggcagcatagcaaaaccccatctctacaaaaaattcaaaaaatatctgggcgtggcggcatacacttgcattcctagctactcatgaggctgacatgagaggattgcttgagcccaggagtttgaggttacagtgagctatgatagcaccactgcaccccaacctgggcgacatagtaagatcctatctcaaaaattaaaatgaaatcttaaaaaagtaaaaaattattccattcttcatacatcaagataaatttcaaatgagtcaaagaagtgaatccatataaataatagaagaaaacatgagtggtcccttcatatcctggcaatgggaaaaatatttcctaaccatga

SEQ ID NO: 12409 - DNA, 69 bp, Homo sapiens
aaccgcattctgctgggaaccgcttctgctgggaaccgcttctgctgggaaccgcattctgctgggaac

SEQ ID NO: 12410 - DNA, 132 bp, Homo sapiens
aagggacccacaggaagttacagtggtgcccacggatgtgtcagcctccagccacggggacgcgggattcaagaatgaagttgatacaggctcagtcaagaccttaaataaaaatttgtacaaagaaaaaaa

SEQ ID NO: 12411 - DNA, 194 bp, Homo sapiens
tgtaagcacagagaggggaaaataattgttcactgttctggggtggaaagggactgaagatacaatcaagaaaaatgtgcacaaaactcatcaggaaacattggctaactgtattttctgataccgtggagttgtatttcccatgggaagtatttgaggatctactgagtcactgaagctggaactggccgcac

SEQ ID NO: 12412 - DNA, 378 bp, Homo sapiens
ggccttcggacgccggattttgacgtgctctcgcgagatttgggtctcttcctaagccggcgctcggcaagttctcccaggagaaagccatgttcagttcgagcgccaagatcgtgaagcccaatggcgagaagccggacgagttcgagtccggcatctcccaggctcttctggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctc

SEQ ID NO: 12413 - DNA, 429 bp, Homo sapiens
atataccaatgatggcgcgatgtaacacgagaaagcacataccaaggccaccacacaccacctgtccaaaaaggccttcgatacgggataatcctatttattacctcagaagtttttttcttcgcaggatttttctgagccttttaccactccagcctagcccctaccccccaattaggagggcactggcccccaacaggcatcaccccgctaaatcccctagaagtcccactcctaaacacatccgtattactcgcatcaggagtatcaatcacctgagctcaccatagtctaatagaaaacaaccgaaaccaaataattcaagcactgcttattacaattttactgggtctctattttaccctcctacaagcctcagagtacttcgagtctcccttcaccatttccgacggcatctacggctcaaca

SEQ ID NO: 12414 - DNA, 474 bp, Homo sapiens
ggggagcagcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagaatgctgtgtcatctgaagaaaccaatgactttaaacaagagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgag

SEQ ID NO: 12415 - DNA, 332 bp, Homo sapiens
gagtttgtaccactgtagcaatagctattgttgcagaaacatgttcaccctttacagtactccctgccttaatgaatgaatacagagttcctgaactgaatgttcaaaatggagtgttaaaatcgctttccttcttgtttgaatatattggtgaaatgggaaaagactacatttatgccgtaacaccgttacttgaagatgctttaatggatagagaccttgtacacagacagacggctagtgcagtggtacagcacatgtcacttggggtttatggatttggttgtgaagattcgctgaatcacttgttgaactatgtatggcccaatgta

SEQ ID NO: 12416 - DNA, 428 bp, Homo sapiens
caggcagtctggaggaacttagacatgttctggagcagctcatcgttgctcacttccccatgcagtccagggaatttcctgcaggaactgcgcggttcaataattatgtggactgcatgaaaaagtttctagatgcattggaattatctcaaagccctatgttgttggaattgatgacagaagttctttgtcgggaacagcagcatgtcatggaagaattatttcaatccagtttcaggaggattgccagaaggggttcatgtgtcacacaagtaggccttctggaaagcatgtatgatatgttcaagaaggatgacccccgcctaagttgcacacgccagtcctttgtggaccgctccctcctcactctgctgtggcactgtagcctggatgctttgagagaattcttcagcacaattgtggtggat

SEQ ID NO: 12417 - DNA, 487 bp, Homo sapiens
agtaggagatggcacagttagctggggtctagaagatgacgaagacatgacacttacaagatggacaggggtgatcattgggcctccaagaacaatttatgaaaaccgaatatacagccttaaaatagaatgtggacctaaatacccagaggcaccctcctttgtaagatttgtaacaaaaattaatatgaatggagtaaatagttctaatggagtggtggacccatgagccatatcagtgctagcaaaatggcagaattcatatagcatcaaagttgtcctgcaagagcttcggcgcctaatgatgtctaaagaaaatatgaaactccctcagccgcccgaaggacagtgttacagcaattaatcaaaaagaaaaaaccacaggcccttccccttccccccaattcgatttaatcagtcttcattttccacagtagtaaattttctagatacgtcttgtagacctcaaagtaccggaaaggaagct

SEQ ID NO: 12418 - DNA, 414 bp, Homo sapiens; identical to SEQ ID NO: 3854

SEQ ID NO: 12419 - DNA, 443 bp, Homo sapiens; identical to SEQ ID NO: 3855

SEQ ID NO: 12420 - DNA, 346 bp, Homo sapiens; identical to SEQ ID NO: 3857

SEQ ID NO: 12421 - DNA, 426 bp, Homo sapiens
tcacaatgctttatattgttcagagaatatttgcattcattacatcaactgcaattcatagggattctgtgagctgatatgtcattacattacttctcaggtgaataatttagtggacttattaaaaattagaaaaaattagaaaccaggcatggtggctcatgcctgtcatcccagcactttgggaggctgacgcgggtggttcacctgaggtcaggagttcgagactagcctggccaacatgatgaaaccccatctatactaaaaatacaaaaattagctgggtgtgatggcatgcccctgtaatcccagctactgcggaggctgacgcatgagaatggcttgaaccacggaggcggaggtggcactgagcggagatcgtgccattgcattccagcctggacaacaaaagcagaactccctctc

SEQ ID NO: 12422 - DNA, 418 bp, Homo sapiens
gagcactctgacctagcagtcaacatgaaggctctcattgttctggggcttgtcctcctttctgttacggtccagggcaaggtctttgaaaggtgtgagttggccagaactctgaaaagattgggaatggatggctacaggggaatcagcctagcaaactggatgtgtttggccaaatgggagagtggttacaacacacgagctacaaactacaatgctggagacagaagcactgattatgggatatttcagatcaatagccgctactggtgtaatgatggcaaaaccccaggagcagttaatgcctgtcatttatcctgcagtgctttgctgcaagataacatcgctgatgctgtagcttgtgcaaagagggttgtccgtgatccacaaggcattagagcatgggtggcatggagaa

SEQ ID NO: 12423 - DNA, 251 bp, Homo sapiens
  misc_feature 251: n = A,T,C or G
ggcgcaatctcggctcactgcaagctctgcctcccgggttcacgccattcttctgcctcagcctcctgagtagttgggactacaggcgcccgccaccacgcccagctaatttttttgtatttttagtagagacggggtttcactgtgttagccaggaactgaccgcaaacgaggccgccagacctacacccgctaccagaccctggagctggagaaagaatttcactacaatcgctacctgacgcggcggn

SEQ ID NO: 12424 - DNA, 390 bp, Homo sapiens; identical to SEQ ID NO: 2908

SEQ ID NO: 12425 - DNA, 353 bp, Homo sapiens
caacctctgactccctggttcaaacgattctcctgcctcagcctcccgagtggctggcatcaccacgcccagctgatttttgtatttttagtagagacggggtttcaccatgttgcccaggatggtctcgatctcctcacctcgtgatccgcccgcctcggcctcccaaagtgctgggattacaggcatgagccaccgcgcccggccccaatcatctgtttttaaacaatcgtttttgagcagatagctattcattccagattttcgtgtacccattctgtttcaggagctcttctaggtaaagctgagatcacaggaacagcaggtgacaggcctagctatagttaggaata

SEQ ID NO: 12426 - DNA, 468 bp, Homo sapiens
ataaagaacgagaacgccaaagggattgggaagacaaagacaaaggacgagatgaccgcagagaaaagcgagaagagatccgagaagataggaatccaagagatggacatgatgaaagaaaatcaaagaagcgctatagaaatgaagggagtcccagccctagacagtccccgaagcgccggcgtgaacattctccggacagtgatgcctacaacagtggagatgataaaaatgaaaaacacagactcttgagccaagttgtacgacctcaagaatctcgttctcttagtccctcgcacctcacagaagacagacagggtagatggaaagaggaggatcgtaaaccagaaaggaaagagagttcaaggcgctacgaagaacaggaactcaaggagaaagtttcttctgtagataaacagagagaacagacagaaatcctggaaagctcaagaatgcgtgcacaggaca

SEQ ID NO: 12427 - DNA, 422 bp, Homo sapiens; identical to SEQ ID NO: 3875

SEQ ID NO: 12428 - DNA, 57 bp, Homo sapiens; identical to SEQ ID NO: 3876

SEQ ID NO: 12429 - DNA, 339 bp, Homo sapiens
tatttaaattattgttaaagaatacacaatttggggtattgggatttttctccttttctctgagacattccaccattttaatttttgtaactgcttatttatgtgaaaagggttatttttacttagcttagctatgtcagccaatccgattgccttaggtgaaagaaaccaccgaaatccctcaggtcccttggtcaggagcctctcaagattttttttgtcagaggctccaaatagaaaataagaaaaggttttcttcattcatggctagagctagatttaactcagtttccaggcacctcagaccaatcatcaactaccattctattccatgtttgc

SEQ ID NO: 12430 - DNA, 437 bp, Homo sapiens
gatcaatgaaggcaggccacttccggcgtagccatggcggctaacgctactaccaacccgtcgcagctgctgccgttagagcttgtggacaaatgtataggatcaagaattcacatcgtgatgaagagtgataaggaaattgttggtactcttctaggatttgatgactttgtcaatacggtactggaagatgtcactgagtttgaaatcacaccagaaggaagaaggattactaaattagatcagattttgctaaatggaaataatataacaatgctggttcctggaggagaaggacctgaagtgtgaatgagtttccttgacttacactagattttgttttggcttataatgacaagaaaatggaattttttttcccactttctaatgtttaaatcccataaagctaagtttcccgttaaagggaagtgctttga

SEQ ID NO: 12431 - DNA, 292 bp, Homo sapiens; identical to SEQ ID NO: 3884

SEQ ID NO: 12432 - DNA, 426 bp, Homo sapiens; identical to SEQ ID NO: 3889

SEQ ID NO: 12433 - DNA, 587 bp, Homo sapiens
ttgcttttcctttactgtgaagataatataatccctgcagtgtttctctgctaacatatgcaatttgcagttctgacagaggtccagttacgtgataaatatcctgtaaagaaccacctccacaaaactccatgcaaatccaaagcttatctcgcctgagatagcttccaaaataagcaacaatatttgggtgtttacagtctttcatcataataatttcttgctgcacaactgcaaagtcttctcctggttccaattttattactttaattgctgctaattcaccagtgttaacattccgtgccttgtagacgtcgccgtaggtgccgctgccgatgcgctgaatcagctcgaagtcctcctgcgggttccggcgggacaaatcgaagccggggttcatggcgggccccaggtgccccccgcctccctcccgggcaggggaggggggccgctcagggggccacacggagagagggcgccgcggccggctcccggctcccccggcggtcacaatcacccggctccacgctgcggccgcaagcttattccctttagtgagggttaattttagcttggcactggccgtc

SEQ ID NO: 12434 - DNA, 213 bp, Homo sapiens
gacgaccgaaggggcatctctactaaaaatacaaaaattatccgggtgtggtggcaggtggctgtaatcccagctactcacgaggccgaggcatgataatcacttgaacctgggagtcagaagttgcagtgagccaagatcgcaccactgcactccagcctggatatatggcaagactctgtctcaagatttatatatatgaaataaaaatac

SEQ ID NO: 12435 - DNA, 226 bp, Homo sapiens; identical to SEQ ID NO: 3896

SEQ ID NO: 12436 - DNA, 331 bp, Homo sapiens
gtacagtggctcacacctgcaatcccagcactttgggaggccgaggtgggcggatcacgacgtcaagagatcgagaccatgctggccaacatggtaaaaccccgtctctactgaaaatttgaaaattagctgggtgtggtggcacacgcctgtagtcccagctactccggaggctgaggcatgataatcgcttgatcccgggacacagaggttgtggtgagccgaaatggctccactgcactacaacatggtgacagagtgagactcagtcccctgaaaaaaaaataagtcccaaaaaaggggcggcctttttttaaaaaacccccccctt

SEQ ID NO: 12437 - DNA, 409 bp, Homo sapiens
ggagtgctgtacaaagagacagaggctgttagctatggctgaaggcaaccacaaaaaaaaacagttaagatgttggaatacctgggcaaagatgttcttcatggtgtttttaattatttggcaaaacacgatgttctgacattgaaggaagaggaaaagaaaaaatattatgataccaaaattgaagacaaggccctgatcttggtagactctttgcgaaagaatcgcgtggctcatcaaatgtttacccaaacacttctcaatatggaccaaaagatcaccagtgtaaaacctcttctgcaaatcgaggctggaccacctgagtcagcataatctacaaatatactcaaactttgtcctcgtgaagaattcctgagactgtgtaaaaaaaatcatgatgagatctatc

SEQ ID NO: 12438 - DNA, 495 bp, Homo sapiens
catgtatcgggaattctgggcaaaacctaagccttagaagaagagatgctgtcttggtcttgttggaggagcttgctttagttagatgtcttattattaaagttacctattattgttggaaataaactaatttgtatgggtttagatggtaacatggcattttgaatattggcttcctttcttgcaggcttgatttgcttggtgaccgaattactagtgactagtttactaactaggtcattcaaggaagtcaagttaacttaaacatgtcacctaaatgcacttgatggtgttgaaatgtccaccttcttaaatttttaagatgaacttagttctaaagaagataacaggccaatcctgaaggtactccctgtttgctgcagaatgtcagatattttggatgttgcataagagtcctatttgccccagttaattcaacttttgtctgcctgttttgtggactggctggctctgttagaactctgtccaaaaagt

SEQ ID NO: 12439 - DNA, 403 bp, Homo sapiens
  misc_feature 281: n = A,T,C or G
gagaagacgacagaaggggaagaaatatgaagaaagttgctaattcttgtgtctttcagtcactccctccaaaatatggagatgctcacaagctataagaaacagtagaaaatgaagcaaaatgttacccgcagtcacttctggagtcacaatataactagaggtaagagcatattcattcatctggagctataacatattgtttaaagtgggggcatgagaatcagcttgcctatgtttacatctcagcggtgacacacatgacaatcacagcttagctntggaaccttgggcaaattattttacctaaatctcaagactcctcttttgtaaaatgggaagttaaaaacatctacctctagcctggaacatagtgagaccctgtctctacagaaaataaatt

SEQ ID NO: 12440 - DNA, 397 bp, Homo sapiens
gaagggtgaaaggcaaggaaggaaggaaggaaggaaggaaggaaggaagttagttgattaaaatttaattaacttaggccaggtgtggtggctcacgcctgtaatcccagcactttgggaggctgaggcaggcagatcacgaggtcaagagattgggaccagcctgaccaacagagtgaaaccctgtctctactaaaaatacaaaaattagctgggcgtagtggcgcacacctgtagtcccagctactcaggaggctgaggcagaagaatcgcttgaacgtgggaggcagagccacggtgcctggccttgtcataaatctttaataagaaaaataacctaattttaaaatgagctcaaggccaagagcagtggctcacgcctataaccccagcactt

SEQ ID NO: 12441 - DNA, 488 bp, Homo sapiens
aattgacaggatttagattttgcttagtttttctgctttttaatgtttctatcccccatctcagtgttttctttatccatcccagtgatgccttatttgaaactgggcttaaactgcaaaaagaatgaagttggatttaggaagctgttagatcattgagtggtgttgagagtgaagtttcactagcagggaagtttccttgagcctaaaataaaaagaaaaaattaaaaagaatcagttttcttaattaaaaaaatagaaagctgttaggctcctaattcgtggggttttttttgtaaaaacagtttagataatcctgaatgcaatcattaacttggttgctaattacaagaatgaaaattataatggaaaaggacaaaataatataccagctggtttgttattatagtccgggtattaaaatactattgaaatacgttaaaggtaaatttttaaggtttaaaaaaaatttagtaacttacagggat

SEQ ID NO: 12442 - DNA, 366 bp, Homo sapiens
cgtcttaaaaaaaaaaatggttataaaaaggccaaacacggtggctcatgcctgtaatcccagcactttgggaggccaaggcgggtggatcacccaagggcagaagttcaaaaccatccagcctgatcaacatggtgaaaccccttttttactaaaaatacaaaaattacccaggcatgggggggcatgcctgtaatctcagctacttgggaggctgaggcaggaaaatcccttgaacctgggaggtgcaggttgctgtgagccaaaataacaccactgcaccctaacctgggcaacaaaagtgaaactccgccttaaaaaaaaaatggtttttaaaaaacaaataaaggaaatcgtttttttttt

SEQ ID NO: 12443 - DNA, 336 bp, Homo sapiens
gattcttcccctctctacaaccctctctcctcagcgcttcttctttcttggtttggtgcttctgagatgtgggcttgcacacgctgttgctatagtacgtgttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggaactgcccagcttcttggggaaaaggacagatgaagctgctttccagaagctgatgagcaacttggacagcaacagggacaacgaggtggacttcc

SEQ ID NO: 12444 - DNA, 400 bp, Homo sapiens
aaggggggagggataaagatttctaagcaaataattgcaatgccttttattcatttattaatagtcaattcactcactcattaattcattctgaaaacatgtggcatttgggctgggcacagtggctcacgcctgtaatcccagcactttgggaggccgaggagggcagatcacttagaggtcaggagttctagaccagcctggtcaacatggcaaaaccccatctctactaaaaatacaaaaaaaatttagccgggcctggtggcaggcacctgtaatcccagctactcgggaggctgaggcaggagaatcgcttgaaccccggaagtggaggttgcagtgagccaggattccactgcactccagcctgggggacagaacgaaactctgcctcaaaaag

SEQ ID NO: 12445 - DNA, 383 bp, Homo sapiens
tataaaacactctgaaatatttctgtccaaagtggtttaaatattacttataataactagtaaaagtttaaaaagtggtctaaagctgggcgcggtggctcacgcctgtaatcccagctctttgggaggccgaggcgggcggatcacaacgtcaggagattgagaccatgttggctaacacggagaaaccccgtctctactaaaaatacaaaaaattaaccgggcgtcgtggctggtgcctgtagtcccagctactcacgaggttgaggcatgataatggcgtgaacctgggaggcggagcttgcactgagccgagattgtgccactgcaatccggcctgggctaaagagcgggactccgtctccaaaaaaaagacttcgact

SEQ ID NO: 12446 - DNA, 499 bp, Homo sapiens; identical to SEQ ID NO: 3907

SEQ ID NO: 12447 - DNA, 454 bp, Homo sapiens
cctctgcctcccgggttcaagcaattctctgcctcagcctcccaagtagttgggattacaggcacctgccaccatgcctggctaattttttgtatttttagtagagacgggggtttcactatgttggctaggctggtcttgaactcctgacctcgtgatccacccgccttggcctcccaaagtgctgggattacaggcatgagccaccgcacctggccttccctgcttcctctctagaatccaattagggatgtttgttactactcatattgattaaaacagttaacaaacttttttctttttaaaatgtgagatcagtgaactctggttttaagataatctgaaacaaggtccttgggagtaataaaattggtcacattctgtaaagcacattctgtttaggaatcaacttatctcaaattgtaactcggggcctaactatatgagatggctg

SEQ ID NO: 12448 - DNA, 337 bp, Homo sapiens
ggctgtgagtgtctctagggtgatacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaagtaactgaaatgaaccagacacactgattggaactgtattatattaaaatactaaaaatc

SEQ ID NO: 12449 - DNA, 410 bp, Homo sapiens; identical to SEQ ID NO: 3912

SEQ ID NO: 12450 - DNA, 549 bp, Homo sapiens
ctctccgccccgcgtccagctcgcccagctcgcccagcgtccgccgcgcctcggccaaggcttcaacggaccacaccaaaatgccatctcaaatggaacacgccatggaaaccatgatgtttacatttcacaaattcgctggggataaaggctacttaacaaaggaggacctgagagtactcatggaaaaggagttccctggatttttggaaaatcaaaaagaccctctggctgtggacaaaataatgaaggacctggaccagtgtagagatggcaaagtgggcttccagagcttcttttccctaattgcgggcctcaccattgcatgcaatgactattttgtagtacacatgaagcagaagggaaagaagtaggcagaaatgagcagttcgctcctccctgataagagttgtcccaaagggtcgcttaaggaatctgccccacagcttcccccatagaaggatttcatgagcagatcaggacacttagcaaatgtaaaaataaaatctaactctcatttgacaagcagagaaagaaaagttaaatacc

SEQ ID NO: 12451 - DNA, 335 bp, Homo sapiens; identical to SEQ ID NO: 3913

SEQ ID NO: 12452 - DNA, 464 bp, Homo sapiens
cccaaagtgctgggattacaggcttgagcccccgcgcccagccatcaaaatgctttttatttctgcatatgttgaatactttttacaatgtaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattctttttctttaaaaaacaactatggatcagaatagccacatttagaacactttttgttatcagtcaatatttttagatagttagaacctggtcctaagcctaaaagtgggcttgattctgcagaaaatcttttacaactgcctcgacacacataaacctttttaaaaatagacactccccgaagtcttttgttcgcatggtcacacactgatg

SEQ ID NO: 12453 - DNA, 532 bp, Homo sapiens
cagaaggggagagtgtggtcaggcggctcggactgagcaggactttccttatcccagttgattgtgcagaatacactgcctgtcgcttgtcttctattcaccatggcttcttctgatatccagttgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctg

SEQ ID NO: 12454 - DNA, 720 bp, Homo sapiens
agcatccacaaagtatattatttccatgagttttctattatgtggagattttccttaagaagtaaaatgaagtttgaatagtacagtctgtggggtggtgacatcagcaaccgccagttcttgtccatcaacaagccccaattctttcaatgttttggagagatttggccttgttcgttcttcaatagaggttaccgactgtaagtaaagggttctattttttccctctagggtggctgtgatggctggagatttcatttgcagagaagcactattggttagataatccaaaacctcctgtagtttagctgatggagaaaactgaatattttgaggaagctggctacaagctgggcaggtttcctttctttctgcttcaaatgtgtatgtatacagcccatctacatcattaaacaccaagtaattattcaagggaatgtatgcacttgtggctattttaaaaacctcagtggcacacacagctgcaatgactgcatttgtggaagctactgcaggaatgattctttttactaccccttgagtgagcctatacgtaacacccctaatattatattgggatgctctctctagggatttttggaaaatccattgtatatgttcaggatcatctccatctaatggaaccccttctccaaaaggctgctccttaggccactggaacatccttacatactaaatacagtgttctggtagccctgg

SEQ ID NO: 12455 - DNA, 476 bp, Homo sapiens
  misc_feature 455: n = A,T,C or G
attccattgtatagatacaacttagtttttcttcttatgaatgaggtggaggattttttcataccgaaagcccttatttttctgtggactgtcagatcatgtcctttgcctatttatgtgttgcactgttggcacttttcttaactcaaacctacaataaatgtgtaggttcactggaaaagaatcaggtctgagaggaaagactttgagcttgtcttgggcacaattatgtttgaagcgcttttgagtcatcttaagaggtaatgtgggccaggcatggtggctcacgcctgtaattccaacattctgggaggctgaggcagtaggatcacttgaggtgaggagttcgagaccagcctgagcaacacaataagaccagtctctacaaaaaattttaaaaattagccagcggtggtgggttgtgcttgtagtctcagcttcttgagagactgagnacggaggatggtttgaaccca

SEQ ID NO: 12456 - DNA, 500 bp, Homo sapiens
catgaaaatttttcttatttttgaaatttcaaagtccaattttataacacaattttacaatgcaaattcttgctgtttcactttctggattcagctgaatagttttgtgaaaatactgacaaacttgccttcacgaactgacttccaagaacaaattgttaaaactttaacagaaaaatcagttaaaggtgctcatcaagagaatccttttcatttggtataaatccaaaactatgaaaataccttttgtattatgtgcatgcagaaaattaagaatttattcaatttgcagaaataaatcagtgatataatggaaacatttaaaattttatctctggaaaataattcaaaatcatctatcaaaaattataggccgggcacagtggctcacgcctctaatcccagcactttgggaggccgaggtggatggatcacctgaggtcaggagttcgagaccagcctgaccaacatggagaaaccccatctctactaaaaataca

SEQ ID NO: 12457 - DNA, 319 bp, Homo sapiens
cacgcctgtaatcccagcactttgggaggccaaggcaggcggatcacctgaggttgggagttcgagaccagcctgaccaaaatgatgaaaccctgtctctactgaaaatacaaaaatcagccaggggtggtggcacatgcctgtaattccagctacttgggaggctgagacaggagaatcgcttgaaccccggaggcggaggttgtggtgagccgagatcgcaccattgcactccagcctgggcaacaagagcgaaactccgtctaaaaaaaaaaagaaaagtagttggaccctgtttttacaaaaagcacaaaaatgg

SEQ ID NO: 12458 - DNA, 438 bp, Homo sapiens
gctgcgatcatgccacggcactctagcctgcatgatagagcgagatcctgtttatgaagaaaaagagactgggcacggtggctcacgcctgtaatcccagcactctgggaggccgaggtgggcggatcacgaggtcaagagatcgagaccatcctggccaacgtggagaaaccctgtctctactgaaaatagaaaaattagctgggtatggtcgcgcacacctgtagtcccagctacttgggaggctgaggcatgagaatcacttgaacccaggagacggaggttgcagtgagctgagatggtgccactgcactccatccagcctggtgacagagcgaggctccctctaaaagaaaaacaatacatgaaaaggaaatgaaggaaatgaaggctgggcatggtagctcatgcctgtaatcccagcactttgggaggccg

SEQ ID NO: 12459 - DNA, 532 bp, Homo sapiens
acagaagggcggctcgctgcaacctctgactccctggttcaaacgattctcctgcctcagcctcccgagtggctggcatcaccacgcccagctgatttttgtatttttagtagagacggggtttcaccatgttgcccaggatggtctcgatctcctcacctcgtgatccgcccgcctcggcctcccaaagtgctgggattacaggcatgagccaccgcgcccggccccaatcatctgtttttaaacaatcgtttttgagcagatagctattcattccagattttcgtgtacccattctgtttcaggagctcttctaggtaaagctgagatcacaggaacagcaggtgacaggcctagctatagttaggaatacacaagccgtaaaatcgagtccttacagccataccacaaggtacgtccatttggactacaagaagagcttcctttaaagttcctatttcagcataaagaggctgtccttttttttgaggaatagtttggaccttgtgcctcctgtgggaggctgaggact

SEQ ID NO: 12460 - DNA, 448 bp, Homo sapiens; identical to SEQ ID NO: 3931

SEQ ID NO: 12461 - DNA, 360 bp, Homo sapiens
gctcttctgaggatccggcaagatggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgcgacatgatcatcctacccgagatggggggcagcatggcgggcggctactaccgcgagaactttaaccaggtggagtatacgcccgagatgatcgg

SEQ ID NO: 12462 - DNA, 288 bp, Homo sapiens
acaatttcatggcaatttatttaaaaaaggtagagaccatgttttttcttttctttaaatctctgtaccctaccgcttggctcaacattaggctctggatataataaagatttgttgaatgaacaagtacacaagtgaaaaatgcttaaaaacatgttctgctcaattggggtcagattgctgtccaaactcctccagtagaggacaatcgcctcctccttatgggaagatctatataatcacagaacagctggactcaaagaggagcctcagctaaggctaatggtt

SEQ ID NO: 12463 - DNA, 366 bp, Homo sapiens
aaggagatctagaggggcacagatccagataaaggtcgcttcatctctctaccccagttgccaccctctgctgtccccgcagagtttgcttggactataaagctgacaggagtgaagtaatcatttgagtgcaagaagaaagaggcgctgctcactgttttcctgcttcagtttttctcttatagtaccatcactataatcaacgaacttctcttctccacccagagatggcttttccaacacattttaattaaaggaactgagtacattaccctgatgtctaaatggaccaaagatctgagatccattgtgagtatatctgtatcaggtcagcaaaagaaggaactgagcaggtgaactctgatg

SEQ ID NO: 12464 - DNA, 432 bp, Homo sapiens; identical to SEQ ID NO: 3947

SEQ ID NO: 12465 - DNA, 229 bp, Homo sapiens
acgacagaagggtacggctgcgagaagacgacagaaggggcccagggaatcaagaaccatagataacggccgggcgcagtggctcacgcctgtaatcccagcactttgggaggccaaggcgggcggatcacctgaggtcaggagtttgagaccagcctgaccaacatggtgaaatccaatctctactaaaaatacaaaaaattatccgggcattgtggtgcgtgcctgg

SEQ ID NO: 12466 - DNA, 63 bp, Homo sapiens
aggaggatgaggataacagtgaaaaaattaaagagcgttcaagaataaattcttctggtgaaa

SEQ ID NO: 12467 - DNA, 67 bp, Homo sapiens
ttacattttcagaggggggggtcttaaacacattccacaaatgccattaaaaatttattttgtttta

SEQ ID NO: 12468 - DNA, 252 bp, Homo sapiens
ggtgcggcgacatgaaactgcttacccacaatctgctgagctcgcatgtgcggggggtggggtcccgtggcttccccctgcgcctccaggccaccgaggtccgtatctgccctgtggaattcaaccccaacttcgtggcgcgtatgatacctaaagtggagtggccggcgttcctggaggcgtccgataacttgcgtctgatccaagtgcccaaagggccggttgagggatatgaggagaatgaggagtttc

SEQ ID NO: 12469 - DNA, 405 bp, Homo sapiens
gagttgcagtcgtgttctccgagttcctgtctctctgccaacgccgcccggatggcttcccaaaaccgcgacccagccgccactagcgtcgccgccgcccgtaaaggagctgagccgagcgggggcgccgcccggggtccggtgggcaaaaggctacagcaggagctgatgaccctcatgatgtctggcgataaagggatttctgccttccctgaatcagacaaccttttcaaatgggtagggaccatccatggagcagctggaacagtatatgaagacctgaggtataagctctcgctagagttccccagtggctacccttacaatgcgcccacagtgaagttcctcacgccctgctatcaccccaacgtggacacccagggtaacatatgcctggacatcctg

SEQ ID NO: 12470 - DNA, 391 bp, Homo sapiens
tgagcaggcagcttacaagttgcctgctcaaaaaaactggaagccaagtacaagaagctggagaagcgatgagaaacttatttctatgggacagagtcttttttttttaatgtggaaaaatgtcttataaaacctgaatcctgaggctgatgaattgtgaaaattcctcaaaaggaaattatgctggtcatcacaggaacatctcaacgttcgagtaaactggaggactgtggctattcctgaaccttctttgaaacaaaatccctcaaaatctcacacttataacttcctaccttttacttgaatgctttgccatattcaggacagagactctcacaaagttcaaaaaacagctggacttaccagtaaaatcaaatgagaggacctattt

SEQ ID NO: 12471 - DNA, 480 bp, Homo sapiens
cactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggattcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatg

SEQ ID NO: 12472 - DNA, 357 bp, Homo sapiens; identical to SEQ ID NO: 3972

SEQ ID NO: 12473 - DNA, 383 bp, Homo sapiens
  misc_feature 383: n = A,T,C or G
gcagagcgagaacagtgcggaggtcgcccagctccggcgctgacgggtgtggaccgcggatgtcgctgggacagcccctccccgctgctcggcggcggcacctggcccggccgctcctcgctgcgcttcgcctccgcctcctcggactcggactcggactcgggtttatatcgcgcctcacttcatcccagtcccgggcgagcagcgttgggtttatgtctttatttgacgaaaacgagctgttgcgcagccattggtacctgtattggggaaacatagcatacaagcaagaagcttacagcctcagtggcgaaaattttttcatgtcagagaccgagaactcttgcagtcgtttatgtcatcccttcttctccagacagaan

SEQ ID NO: 12474 - DNA, 344 bp, Homo sapiens
  misc_feature 344: n = A,T,C or G
gggatgacaagtttgttcatcttaaggcaacagaagaaaatataaaaaacttcataaactgctttgtaatgaaaaactaaaataaaaaagaacaaacttggaaaaggtacgacaaatattacaaagggttacatattgccaggcacaatggcactaaaataaaaaaagaaaaaacttggaaaaaatactcatgacaaatatcacaaagagttacatattgccaagtgcagtggcacacacctggactcccagctacacaggcggctgaggtgggagtatcactttgagcctaggagttcgagaccaaaccagacaacttacttaggaagacctagtttctaaan

SEQ ID NO: 12475 - DNA, 430 bp, Homo sapiens
cagcccaggcaacagagcaagactctgtttcaaaaaagaaagtttattattctgaaacagtcaaattctttgcatataaaaatgtacaataattttatatttgcacatattgcagttgcttctatgcttccttttaaatgggaacgcctggccgggcgcggtggctcacgcctgtaatcccagcactttgggaggccgaggcgggcggatcacgaggtcaggagatcgagaccatcctggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtccc

SEQ ID NO: 12476 - DNA, 595 bp, Homo sapiens
gagtgagtttttccgtgctgtgtaggggctaacaatggacacccagaaggacgttcaacctccaaagcagcaaccaatgatatatatctgtggagagtgtcacacagaaaatgaaataaaatctagggatccaatcagatgcagagaatgtggatacagaataatgtacaagaaaaggactaaaagattggtcgtttttgatgctcgatgaatgctgggaattcagaggaatgtcttcacttatacttggatttgctctcttcccatttctgattgttgtatagctttcgattttgcttacagtagttcccccttatcttcgggagatacattccaaggcccccagtgaactcctgaaacctcaaacagtaccaaacctttatacactgttttttccatatatatatacctatgataaagtataatgtataaattaagcatagcaagagattaataataatgtaatagaacaatgataacatactataataaaagttatgtgaatgtggttggtctctcttgctttcaaaatatcttcttgtacagtactcacctattttagaatgtggttgactacaggtaaccaaaaccacag

SEQ ID NO: 12477 - DNA, 885 bp, Homo sapiens
gaatattgtggacatcatggacttgatatgatagaaatcaattgtcagcttgagaaagttgtttttaatctgtctaaatagttcatgcattactacagttaaaaatagtttcatttgtcttctatagacttaattttattccggttcagtataatctctgttaacagagtttcagcaaactgattggtcaaggtattaacatagcttctacttcctttacttaaaaagatgtggttttatgtaagttcttgattactgatgatcatcccaaattttgacaacaaaatcatatgtataaatttatttctcccctcttgttcatcatcttttgtaaaggtcccattgtagatcttttctgctaccaaataaaacttttcaaacaatttggtttcaagaccttaaatagacaagttggatactaagattgtgaactgataaggacatataaatttatatttccagcccttccttagagtctttatctgcatcaaaaacccaattctgccattaactgtgcttcgcagtcgcacatctatatgtcactcattttctgcaacaagatgcactaaatcatgtgaacgacagcatgatctctctaagtaatagaaaagtcctggaaactctgtgcacatgacgtgcatgtaccctcagcagcagtgtgcagcattatgtgaaagcccatataggctgctgacattcttcgaatagtttagaaaggctgggatgccgtatatggcggtgtatcttgaagtcaaagccgagctttataacactggtgcgtgcccccgctgctcctatcgtgggggggcgattattgcggcaacagggtgcttgccccacatggtgatgcctcttaggagtatcggcgatcaacagggaatcgta

SEQ ID NO: 12478 - DNA, 183 bp, Homo sapiens
tgagcctctttgatctcttccggggctttttcgggtttcctggacctcggagccacagagatcccttttttggagggatgactctgcttgaagatgatgatgaggaacacgatcaagaagggggctcatggggccgcgggaacccaaggttccataaccctcaccacccccctgaggaatttg

SEQ ID NO: 12479 - DNA, 258 bp, Homo sapiens
  misc_feature 204: n = A,T,C or G
tgctcctcagcacatagtagatgctttaaagtcagaggacttggtcgggcgcagtggctcacgcctgtaatcctagcactttgggaggctgaggagggcagatcacctgtggtcaggagttcgagaccagcctgatcaatatggtgaaaccctgtctctactaaaatacaaaaattatccaggtgtggtggtgggtgcctgtantcccagctacttgggaggctaagacaggagaatcgcttgaacccgggaggtgga

SEQ ID NO: 12480 - DNA, 409 bp, Homo sapiens
gttatgctatatggcaagggagaattacagttgcagatggaattaatgttgctaatcagttgaccataaaatagggagaccataatatggtcaataggagtttaccataaagctaggttttgtagttgggagggagggtgtagtgtattcagaaatatcctggccgggcacggtggctcacacctgtaatctcagcactttgggaggccaaggcaggcagatcatgaggtcaagagttagagaccagcctgaccaacacggtaaaaccccatctctactaaaaatacataagttagccaggtgtggtggtgcacgcctgtaatcccagctactcaggagactgaggcagtagaatcacttgaatccaggaggcggaggttacagtgagctgagattgcatcactgcact

SEQ ID NO: 12481 - DNA, 505 bp, Homo sapiens
gggcagattttcatgcaaaagttctcatatgagttagaggagaaaaagcttaatgattctgatatgtatccatcaggatccagtctggaaaacagaaaccattctaggtgtttcaacagagggagtttaatacaggaaattgacttacatagatgataaaagagaagccaaacagcaagaagctgttaccacacccagggctatgaggataatgggaagaggtttggtttcctgtgtccagtagtgggatcatccagaggagctggaaccatggtgggggctgcctagtgggagttagggccaccaatggattgtggaaaatggagccatgacaagaacaaagccactgactgagatggagtgagctgagacagataagagaataccttggtctcacctatcctgccctcacatcttccaccagcaccttactgcccaggcctatctggaagccacctcaccaaggaccttggaagagcaagggacagtgaggcaggagaagaac

SEQ ID NO: 12482 - DNA, 424 bp, Homo sapiens; identical to SEQ ID NO: 3988

SEQ ID NO: 12483 - DNA, 447 bp, Homo sapiens
gcctttgagagaggtttccgctgtaggagcagagcttccgggctgcgctcttcgttgcccagtttccgctcagtggtcgcgtctccgccccccacccaccagtcccgctgcattctcggccgggctctaggcgccatggctccccgtgggaggaagcgttaggctgaggccgcggtggtcgccgtagccgagaagcgagagaagctggcgaacggcggggagggaatggaggaggcgaccgttgttatcgagcattgcactagctgacgcgtctatgggcgcatcgccgcggtcctgagccaggcgctgcgcctggaggccccagatcttccagtaaaggtgaacccgaccaagccccggaggggcagcttcgaggtgacgctgctgctcccggacggcagcagtgcggagctctggactgggattaagaaggggcccccacgcaaa

SEQ ID NO: 12484 - DNA, 382 bp, Homo sapiens; identical to SEQ ID NO: 1020

SEQ ID NO: 12485 - DNA, 319 bp, Homo sapiens
actgacttcaagctatggtaaggactgtggcttctattctaatatgaatagtcttaggcaggcattgatggcttttaactacaccaactgcactatctgatatatacagtcctaaaggaccctaccttacagcctggacaacttagtgatcctatatctctacaaaaaaaatatttaaatcaattatccaagcatggtgctgcacaccttgtagccccagctatttatgaagctgcggcaggaggatctcataaggccaggagttggagactgctctgagctaccactgccagcctgagtgacagagcaagaccttgtt

SEQ ID NO: 12486 - DNA, 385 bp, Homo sapiens; identical to SEQ ID NO: 3995

SEQ ID NO: 12487 - DNA, 56 bp, Homo sapiens; identical to SEQ ID NO: 2931

SEQ ID NO: 12488 - DNA, 158 bp, Homo sapiens
ggcttttaaaaatctaatatgaggccaggcgcggtggctcacgcctgtaatcccagcactttgggaggctgaggtgggtagatcacgaggtcaggagatcaagaccatcctggccaacatggtgaaaccctgtctctactaaaaatacaaaaattagc

SEQ ID NO: 12489 - DNA, 88 bp, Homo sapiens
ggaaacatatttcttgtgaaatggacatatatcttttttatactccccataaaaagggatgtgagggcaaataaatttgggaaaaatg

SEQ ID NO: 12490 - DNA, 54 bp, Homo sapiens
gggagtgataccgtttgcctgtgtcttcacccaaatctcaacttgaattgtatt

SEQ ID NO: 12491 - DNA, 364 bp, Homo sapiens
  misc_feature 364: n = A,T,C or G
acgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagccttgctagatggcaagcatgtggtgtttggcaan

SEQ ID NO: 12492 - DNA, 371 bp, Homo sapiens; identical to SEQ ID NO: 4006

SEQ ID NO: 12493 - DNA, 370 bp, Homo sapiens
atcaccaggtcaggacttcaagaccagcctggccaacatggtgaaaccctgtctctactaaaaatacaaaaatgagccaggagtggtgacgtgcgcctgtgatcccagctactcgggaggctgagacagaagaattgcttcaacctgggagttggaggttgcagtgagctgagatcgtgccactgcactccagcctgggtgatagcaagactccgtgtcttaaaataatataagtagaaaaaaatgtccataacgaacagacagcatatttactatttattaaaaggaaaagggatcttcatatcgggccatcgtgttttgattacacatatcagacatctcgttgcataatacgcgtcgatgtccaccc

SEQ ID NO: 12494 - DNA, 386 bp, Homo sapiens
agaataattgtaactcatattctagtggtcaatactgggatcatatgaaatacataagtagacatacaaactagaaatacattttagtttaaaatgaaaaatgtgggccgggcgcggtggctcacgcctgtaatcccagcactttgggaggctgaggtgggtggatcacgaagtcaggaggtcgagaccatcctggctaacatggttaaaccccgtctctactaaaaatacaaaaaattagccaggcgtggtggtgggcacctgtagtcccagctacttgggaggccgagacaggagaatggcgtgaacccacgaggcagagcttgcagtgagccgagattgcaccactgtactccagcctgggtgacagagcgagactctctccg

SEQ ID NO: 12495 - DNA, 116 bp, Homo sapiens
gttctgggcctagttgtcctccctcctggagccccggcctgtggtctgactcagcttcccctcctaatacatatggctgtttgccacctcgatcctataacacgagtttgggcccg

SEQ ID NO: 12496 - DNA, 472 bp, Homo sapiens
ctacaccaacctgcttccactttattcttgtttacacattctcctgctcccagatttggagggaagaaagcagaagaaaagatgcaggactgagatgattcatggaacccaagtccattaaaactggctgcccctcatctccaagcaatatattggtgggcttcaagtctctgtgggcataacccttggcatgaatggcctcaaggctcctgcagatccccagcagcagccaaaggatttgatcctcggtcaggaagttgcctttgtccttcagcctttctatctcattccacagcgtacctctcttgaagaatggtagcagcagccaggcctcatgcttagcaccccgttccctcagacagtaagccacgagggaaaggatgttggggtgattgaagaggcgatgcatgtcggcttctcgctgggcctcctcccggtcctgctgctcgtgaacaaggattcgcttcagggc

SEQ ID NO: 12497 - DNA, 628 bp, Homo sapiens
cataagcacaaaaaatttattctgaataaatcactttacaattactgaaaaagatgttcattaccttagctatgtacttaatgaaccaaattacccaaacaaaataaacatggcaatataaaaatgttaagaatttacaaagctgtacaaaataacttaaaatttaaaaattagactgatacagtctgtaagatctcttcgagagagctgtccaattacagatctatatacttttcttcagaaggtcaaagaaaggatgctttaaggcttctctgagagtaattcttttggctggatcatactccaacattttctgaatgaggtcaaagagacgctcatgttcaacatcttgagaaagcataaattccttcagaggtttacagcgtcttgaaacatatctgccggcagaactgtgttcatcccagtctaatcgatcgtggtgaaaatatttacgtttcctggttttctgtatcatatgttttggtagaggtccaagaatcctttccatcattgctaaatgctccttactatcgtgtgttggaaatacggtaaacccaagatagtattcaataagaatgcatcctatgctccagacatcacatggttgggaccaccctagggctaaaat

SEQ ID NO: 12498 - DNA, 457 bp, Homo sapiens
gggatcttggctcactgcaacctccacctccaaggttcaagcaattcttctgtctcagcctcctgagtagctgggattacaggcatgtgccaccacaccctgataatttttgtatttttagtagaaatggggtttcaccatgttggccaggctggtctcgaacccctgacctcaggtggccgacccgcctcgacctcctaaagtgctgggattacaggtgtgagccaccaagcctggataatagtatgactaaatttaatctaagactccctagaatgtgtcacaaaaaagcaaaaattgaataaactacagagcaagccaagcattaagactgccttgtgctttcctactcagtgtacaagtagagaaggcctgggatgcgccaggcactgtgcctgatagctcctcacttgaaataaacttacaaaagtgattgtatcccccctttaaagatgag

SEQ ID NO: 12499 - DNA, 353 bp, Homo sapiens
acagaagggctctgtgccaatacattaatatacaaactttctaatatcattaagaaataagtacatttaggccgggcagggtggctcatgcctgtaatcccagcactttgggaggctgaggcagggagatcacttgaggtcaggagttcgagaccaacctggccaccacggtaaactcatctctactaaaaatacaggaattagccaggagtggtggtgggcacctataatcccagctactagggaggctgaggcacaagaatcacttcaacctgagagacagaggtttcagtgagctgagatcgtgccaccacactccagcttgggcaacagtgtgagcaaaactctgtctc

SEQ ID NO: 12500 - DNA, 353 bp, Homo sapiens
gttctttgcaggtcataaaaagtgggagattcctttaactctggctgcatcccagagctttgtcactgtgtaaaagtggaatgccggccgggcacgctggctcacgcctgtaatcccaacactttgggaggccgaggcgggcggatcacgaggtcaggagatcgagaccatcctggctaacatggtgaaaccccgtctctactaaaaatacaaaacaaaattagccaggcatgatggcgggcacctgtagtcccagctactctgtaggctgaggcaggagaatggcgtgaacccgggaggcggagcttgcagtgagctgggattgcgccactgcactccagcctgggcgacag

SEQ ID NO: 12501 - DNA, 469 bp, Homo sapiens
cagaagggagaagtggagcctggaagtggaatcagggtcgagacaggaaggccagcctgcttcgggctcctccccttcctttgttcataggcctcagctgtgagagaagttaactgcccctgtgcctaggggacctgggttgggttgtccggggagtaagttctaaaggggccccttgtcttttgaggggccaggcggtagggtagggcttggctccagagggtagggaaccacagcagaagcaatgaagaggaggaatccgccaggtgcggtggcttacgcctgtaatcccagcactttgggatgctgaggcgggcagatcacaaggtcatgagttcatgaattcgagaccagcctggacaatacggtaaaaccccgtctctactaaaaatacaaaaattagctgggcatggtggcgcgcgcctgtagtcccagctactcgagaggctgaggcagaagaattgcttga

SEQ ID NO: 12502 - DNA, 380 bp, Homo sapiens
ctaattacggataatcacagtagaaaataaaacttgattccctttcctgcatggcttgagcatgaaataggagaagggacatgacaacctccgggtgtcgttactaattctttaaaaagttgtacttgcagccaggcacggtggctcactcctgtaatcctagcactttgggaggctgatgcaggcggattgcctgagctcaggagttcgagaccagcctgcgcaacatggagaaacgccgtctctactaaaaacacacaaaattagccaggaatggcagtgtgcacctgtagtcccagctactctggagactgaagcaggagaattgcttgaacccaggaggcagaggttgccctgagctgagatcgcaccactgcact

SEQ ID NO: 12503 - DNA, 125 bp, Homo sapiens; identical to SEQ ID NO: 1051

SEQ ID NO: 12504 - DNA, 380 bp, Homo sapiens
tctacggttgcgagaaaacgtcacaagggctgttggccaagcactgtggctcacgcctgcaatcccagcactttgggaggccaaggggggcggatcacctgagctccggtgttcaagaccaccctgggcaacatggtgaaaccctgtctctactaaaatacaaaaaattagccagacatggtggcatgcgcctgtagtctcagctactcaggaagccgaggcatgagaatcgtttgagctcaggaggcagaggttgcagtgagccaagatcacaccaccacactccagcttgggctacagagtgagactatgtctcataaaaaaaaagaacctctgttaaaggattccttttaatcctttccagagccagtatttatgtt

SEQ ID NO: 12505 - DNA, 384 bp, Homo sapiens; identical to SEQ ID NO: 4030

SEQ ID NO: 12506 - DNA, 221 bp, Homo sapiens; identical to SEQ ID NO: 4032

SEQ ID NO: 12507 - DNA, 492 bp, Homo sapiens
cagacgctagacgccgggcctacagcgggagcgtgaggaaagccgtgcgttgcgttccaaggcatctgtgagcccgcggagtatacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttgttaaataaacttttgtaatagtcaaaaatgctttctcagatgttctgaatatagaatatcagctctcatt

SEQ ID NO: 12508 - DNA, 491 bp, Homo sapiens
gctaatgctgcatgcccgttgctgcctgaatcagaagggcaccatcttggggctggatctccagaactgttctctggaggaccctggtccaaactttcatcaggcacataccactgtcatcatagacctgcaagcaaaccccctcaaaggtgacttggccaacaccttccgtggctttactcagctccagactctgatactgccacaacatgtcaactgtcctggaggaattaatgcctggaatactatcacctcttatatagacaaccaaatctgtcaagggcaaaagaacctttgcaataacactggggacccagaaatgtgtcctgagaatggatcttgtgtacctgatggtccaggtcttttgcagtgtgtttgtgctgatggtttccatggatacaagtgtatgcgccagggctcgttctcactgcttatgttcttcgggattctgggatccaccactctatccgtctccattctgctttgggcga

SEQ ID NO: 12509 - DNA, 326 bp, Homo sapiens
ggtcatttcagaaaattcttcatagtggtattggccttatatttaactttttttttatttttttttttgagacaaagccacactctgtctccttggctggagtgggggggcacagtctaagctaactgcaacctctgcctcccagttaaagcaattcttctgcctcagcctcccaagtagctgggattacaggcacccgccaccacgcccagctaatatttgtatttttgtagagatggggtttcacgatgttggccaggctggtctcaaacttctgacctcaagtgatctgcccaccttggcctcccaaagtgctgggattacag

SEQ ID NO: 12510 - DNA, 219 bp, Homo sapiens
tctcttcttccttaaaggtactgtgcagagttctggccggacatggtggctcacgtctgtaatcccagcactttgggaggctgacggcgggtggatcacctgaggtccagagttcgagaccagcctgacaaacatggcgaaaccctatctctactaaaagtacaaaaattagctgggcgtggtggcgggtgcctgtaatcccagctactccggaggctg

SEQ ID NO: 12511 - DNA, 453 bp, Homo sapiens; identical to SEQ ID NO: 4044

SEQ ID NO: 12512 - DNA, 402 bp, Homo sapiens
ccctggatgtcctctatgggccggacacccccatcatttcccccccagactcgtcttacctttcgggagcgaacctcaacctctcctgccactctgcctctaacccatccccgcagtattcttggcgtatcaatgggataccgcagcaacacacacatgttctctttatcgccaaaatcacgccaaataataacgggacctatgcctgttttgtctctaacttggctactggccgcaataattccatagtcaagagcatcacagtctctgcatctggaacttctcctggtctctcaactggggccactgtcggcatcatgattggagtgctggttggggttgctctgatatagcagccctggtgtagtttcttcatttcaggaagactgacagttgttttgc

SEQ ID NO: 12513 - DNA, 379 bp, Homo sapiens
attggttttgggccaggcacggtggctcatgcctgtaatcccagcactttgggaggctgaggcaggtggatcacctgaggtcaggggttcgagaccagcctggccaacatggtgacaccccgtctctactaaaaatacaaaaattagctggatgtggtggcacacacctttaatcccagctgctcaggaggctgaggcatgagaatcacttgaagacagaggttgcaaggagctgaagttgcgccactgtactccagcttgagtgacagattgagaccgagtctccaaataataaataaaataattgcttttgccactgttattcatttgacataatcaaaaatgggactaaaagtacattatcatagaacccatgatt

SEQ ID NO: 12514 - DNA, 415 bp, Homo sapiens
gagtggcttgaggtatccgcaggagcggccgggtggcgggaggaaccgttacgggaactgaagttgcggattaagcctgatcaagatgacaacctcccaaaagcaccgagacttcgtggcagagcccatgggggagaagccagtggggagcctggctgggattggtgaagtcctgggcaagaagctggaggaaaggggttttgacaaggcctatgttgtccttggccagtttctggtgctaaagaaagatgaagacctcttccgggaatggctgaaagacacttgtggcgccaacgccaagcagtcccgggactgcttcggatgccttcgagagtggtgcgacgccttcttgtgatgctctctgggaagctctcaatccccagccctcatccagagtttgcagccgagtagggac

SEQ ID NO: 12515 - DNA, 463 bp, Homo sapiens
gtgccagacagcacagactttccaggacagccctgcgtaaaacagcctgccttgctggtgccccaccaggaaagtacactgggtacttgatgcttgatcttgcacagaaaagatggccatgggccgggcatggtggctcacgcctgtaatcccagcactttgggaggccgaggcaggtggatcacctaaggtcaggagttcgagaacagcctaacatggtgaaaccccatctctactaaaaatacaaaccttagtcgggcatggtggcatgtgcctgtaatcccagctacttaggaggatgaggcaggagaattgcttgaggtcaggagttcgagaccagcctgactaacatggtgaaaccctgccactactaaaaatacaaaacgtagctgggcatggtggcccatgcctgtaatcccagctactcgggaggctgaggcagaagaatagcttgaatctgggt

SEQ ID NO: 12516 - DNA, 181 bp, Homo sapiens
aattacctaaatgctagtcttacagaaagtaatcagccgggcgcggtggctcacgcctgtaatcccaacactttgagaggccaaggcaggcggatctcttgaggttaggattttgagaccagcctggccaacatggtgaaaaacccgtcttgactaaaaatacaacaattagctgggcatg

SEQ ID NO: 12517 - DNA, 251 bp, Homo sapiens
  misc_feature 251: n = A,T,C or G
gagaagacgacagaagggaagaactagccttggagtcaggcctccaaccaagtagatctgtcagagattgatttggttgggaagctaatggaggaggaggagtactgtaagtagctgaaaccatctaattgatgtgggctaaagatgatttagagaactaagaaaggaaagagaaggaaggaaggaagagagggagggaggtgagcaaggggagggaggtgttacaaggggagaaggagagagagacatan

SEQ ID NO: 12518 - DNA, 115 bp, Homo sapiens
tgcctgggaacccccattttgcctgggaacccccattttgcctgggaacccccattttgcctgggaacccccatttttgctgggaaaccccatttttgctgggaaaccccattct

SEQ ID NO: 12519 - DNA, 366 bp, Homo sapiens
gagacaaaagcaactgaggtgggcccaatggcatccatgatgggcagaggcacacacatcgctccgctctgtccactcaaaaaagcagcaaaggctgggcgcggtggcacgcgcctataatcccagcactttgggaggccaaggcgggcggatcatgacgtcaggagatcgagaccatgctggctaacacggagaaaccccatctctactaaaaatacaaaaaattagccgggcgcggtggctggcgcctgtagtcccagctactccggaggctgaggcatgataatggcgtgaacccaggaggcggagcctgcagcgagccaagatcgtgccactgcactccggcctgggcgaaagagcaagact

SEQ ID NO: 12520 - DNA, 441 bp, Homo sapiens; identical to SEQ ID NO: 4083

SEQ ID NO: 12521 - DNA, 356 bp, Homo sapiens
cttgagccttatagatgcattttgaacagctacaaaggacagcatgaaacctgaagttaaaagtgtcggcccggccaagtggggtgtctcacgcctataatcgtagcgctgtgggaggcccatgtgggtggatcatctgaggtcgggagtttaagaccagcctggacaacatggagaaactcccgtctctactaaaaatacataacttagctgggcgtggtggcacacacctgtaatcccagctactcagtaggctgaagaaggataattgcttgaacccaggaggtggagattgaagtgagctgagatcgtaccactgaactccagtctgagctaagggagggagacttcatctt

SEQ ID NO: 12522 - DNA, 130 bp, Homo sapiens
gaatttgtgtttacatatctgacatggaatgcaactgtgctagccaagattcggtgtagcttaccagccagaaatcacatatcctaacaggtagaaatgcattgcattttgtaaaactgcgcagctatgc

SEQ ID NO: 12523 - DNA, 359 bp, Homo sapiens
ggcgcacggtggagccgccagctgagaaggactctgatccggctcagctttccaatcagctgtggaaggagccacgctttctggggttgcaagatggcggccagcagtggaactgatgagccggtttccggggagttggtgtctgtggcacatgctctttctctcccagcagagtcgtatggcaacgatactgacattgagatggcttgggccatgagagcaatgcagcatgctgaagtctattacacgctgatttcatcagtggacccacagttcctgaaactcaccaaagttgatgacctaatttactctgagttccggaaaaattttgagacccttaggatagatgtgttggaccc

SEQ ID NO: 12524 - DNA, 404 bp, Homo sapiens; identical to SEQ ID NO: 4086

SEQ ID NO: 12525 - DNA, 146 bp, Homo sapiens
ctcctgacctgaactgatccacccgcctcagactcccaaagtgctaggattacaggtgtgagccactgcacgcgggcctgcccccagtctcgaccattctactaattttaaagacctcttggaattttacactcttggaatcatag

SEQ ID NO: 12526 - DNA, 443 bp, Homo sapiens; identical to SEQ ID NO: 4087

SEQ ID NO: 12527 - DNA, 330 bp, Homo sapiens
gaaagataatgttgaaagtgctcaagcatctgaagtcaaacctctgagaagctgaatttgaaaaggaatgtttgaatttatatagcaagtgctatttcagcaacaaccatctcatcctattacttttcatctaacgtgcattataattttttaaacagatattccctcttgtcctttaatatttgctaaatatttcttttttgaggtggagtcttgctctgtcgcccaggctggagtacagtggtgtgatcccagctcactgcaacctccgcctcctgggttcacatgattctcctgcctcagcttcctaagtagctgggtttacaggcc

SEQ ID NO: 12528 - DNA, 417 bp, Homo sapiens
aactgacttccaagaacaaattgttaaaactttaacagaaaaaccagttaaaggcgctcatcaagagagtccttttcatttggtataaatccaaaactatgaaaataccttttgtattatgtgcatgcagaaaattaagaatttattcaatttgcagaaataaatcagtgatataatggaaacatttaaaattttatctctggaaaataatccaaaatcatctatcaaaaattataggccgggcgcagtggctcacgcctctaatcccagcactttgggaggccgaggtggatggatcacctgaggtcaggagttcgagaccagcctgaccaacgtggagaaaccccatctctactaaaaatacaaaaaaaattagccaggtgtggtggcgcatgcctgtaatcccagctactcggg

SEQ ID NO: 12529 - DNA, 547 bp, Homo sapiens
ccaagaattcggcacgagaaagattctccaataagacacagtagagtctctagccaaaagtgattgaggtcccttcatctctgctgtttgttcaatgtaaattagccatcatcctccctgtttgtttttctcatcttcccacatgggctcaacaccatccttaaaaagtgagtagtcacagccagacattaaattactagacaactggatatggttgtacagagcccaaaagtcaacaggatcaaacttagagatcagcggcaggtttgcttgtcaagttttgcttttatcttttttaaaaaaaccagagtgcccatctgttctgtagaggatgtttaatatagtgttctgggttagcaacctcctgattagattctgttttctcctcttcacagggggattaggagtaggggtggtttctggtttgacagtccgccgtcttacatcgatctgctcctgcttttaactctgctcttgtttcctaccactggcctgggagccagccttttcagttctctcactgacaaactttcagttcttatttatc

SEQ ID NO: 12530 - DNA, 502 bp, Homo sapiens
agttactgaaaatctgggtagtaaatctacccaattaaaatggcactttataaaagggaatagagaagagatgggactatttctatatttaaatgctgctggctattcctttgtatataaatgaaaaataccattcattaaaattaagtactcgtttaagtatggttcttaattacatttcattcatttatattagagtaaatggcttcataactactttaaaatttaacccacaagcatattaaatctgtttgttataagattggaaacaatttttgagagggactaatttaaacaagtcctcctttagtcttctgggtcgcgtagttgctgaaacctaagtacctgcagcctacaggataaggaagttcacagcctgcggggtgaatgaacccatgtgtgaactgcacagagcaattcatagaaaatgcatacaaatttgtaacactttggtcacatctgtctctagatgggcattgaatttgtttaaagatggatgaaa

SEQ ID NO: 12531 - DNA, 342 bp, Homo sapiens; identical to SEQ ID NO: 4103

SEQ ID NO: 12532 - DNA, 337 bp, Homo sapiens
gaatgtattgaaggattactttttaggtagacttgagaaaaatatgagacacagaaggaaaggaattaatcagagaaagaacgcttgcagtcctagcactttgggaggccaaggcaggtggatcacctgaggtcgggagttcgagaccagcctgaccaacatggggaaaccccatctctactaaaaacacaaagtggccgggcacggtggctcactcctgtaatcccaccactttgggaggccaaggcgggcagatcacgagctcaggagattaagaccatcctggctaacatggtgaaaccccgtctctactaaaaatacaaaaaactagccgggc

SEQ ID NO: 12533 - DNA, 323 bp, Homo sapiens
gcctccacctcccggattcaagcgattctcctgacttagcctcccaagtagctggggttacaggcgcctgccaccacgcccggctaattttttgtatttttagtagagacggggtttcgccatgttggccaggatggtctggatctcctgatttcatgatctgcccgccttggcctcccaaagtgtggggatgacaggtgtgagccaccgcgcccggccgagaacctgtctcttttaaacaaacaaacaaaaaataaaatacaagaggagagataacctaaaggaaagcctgttaaacaacaaggagccaggaattgctagtt

SEQ ID NO: 12534 - DNA, 486 bp, Homo sapiens
ggagtctctttgcggcgctacactagagcagagtacgagtctgaggcggagggagtaatggcaggacaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaaggaaagggtggagagattcaaccagttagcgtgaaagttggagataaagttcttctcccagaatatggaggcaccaaagtagttctagatgacaaggattatttcctatttagagatggtgacattcttggaaagtacgtagactgaaataagtcactattgaaatggcatcaacatgatgctgcccattccactgaagttctgaaatctttcgtcatgtaaataatttccatatttctcttttataataaactaatgataactaat

SEQ ID NO: 12535 - DNA, 186 bp, Homo sapiens; identical to SEQ ID NO: 4116

SEQ ID NO: 12536 - DNA, 386 bp, Homo sapiens; identical to SEQ ID NO: 4123

SEQ ID NO: 12537 - DNA, 467 bp, Homo sapiens; identical to SEQ ID NO: 2913

SEQ ID NO: 12538 - DNA, 458 bp, Homo sapiens; identical to SEQ ID NO: 4128

SEQ ID NO: 12539 - DNA, 405 bp, Homo sapiens
cagaagggggggcagccatggcgtcctatttcgatgaacacgactgcgagccgtcggaccctgagcaggagacgcgaaccaacatgctgctggagctcgcaagggcacttttcaataggatggactttgaagacttggggttggtagtagattgggaccaccacctgcctccaccagctgccaagactgtggttgagaacctccccaggacagtcatcagaggctctcaggctgagctcaagtgccccgtgtgtcttttggaatttgaggaggaggagactgccattgagatgccttgccatcaccttttccattccagctgcattctgccctggctaagcaagacaaattcctgtcccttgtgccgctatgagctgcccactgatgacgacacttatgaggagc

SEQ ID NO: 12540 - DNA, 379 bp, Homo sapiens; identical to SEQ ID NO: 4138

SEQ ID NO: 12541 - DNA, 295 bp, Homo sapiens
tctcttcttccttaaaggtactgtgcagagttctggccggacatggtggctcacgtctgtaatcccagcactttgggaggctgacggcgggtggatcacctgaggtccagagttcgagaccagcctgacaaacatggcgaaaccctatctctactaaaagtacaaaaattagctgggcgtggtggcgggtgcctgtaatcccagctactccggaggctgaggcaggagaatcacttgaacccaggaggcagaggttgcagtaagccgagatcatgccactgcactccagcctggg

SEQ ID NO: 12542 - DNA, 505 bp, Homo sapiens; identical to SEQ ID NO: 4148

SEQ ID NO: 12543 - DNA, 462 bp, Homo sapiens; identical to SEQ ID NO: 4160

SEQ ID NO: 12544 - DNA, 526 bp, Homo sapiens
gggctcaataccccaagcaatacctgcaactgaggattcttcccggggagaccgcagcccatcggcatggctcaagagtttgtgaactgcaaaatccagcctgggaaggtggtcgtgttcatcaagcccacctgcccgtactgcaggagggcccaagagatcctcagtcaattgcccatcaaacaagggcttctggaatttgtcgatatcacagccaccaaccacactaacgagattcaagattatttgcaacagctcacgggagcaagaacggtgcctcgagtctttattggtaaagattgtataggcggatgcagagatctagtctctttgcaacagagtggggaactgctgacgcggctaaagcatattggagctctgcagtaaccacagatctcataggaaatgttcaacaattctgtgaaaggtcacaggacccaattggagaaatcataaaaagcatagttggtcttggtgtcatatggatcacaggcacaagtgcagatgctgtggtcatgcggaacac

SEQ ID NO: 12545 - DNA, 503 bp, Homo sapiens
acagaagggtaaagacccaattacagaatttgttgaatgtttatatgttaactttgactttgatggggctcagaaaaagctgagggaatgtgaatcagtgcttgtgaatgacttcttcttggtggcttgtcttgaggatttcattgaaaatgcccgtctcttcatatttgagactttctgtcgcatccaccagtgtatcagcattaacatgttggcagataaattgaacatgactccagaagaagctgaaaggtggattgtaaatttgattagaaatgcaagactggatgccaagattgattctaaattaggtcatgtggttatgggtaacaatgcagtctcaccctatcagcaagtgattgaaaagaccaaaagcctttcctttagaagccagatgttggccatgaatattgagaagaaacttaatcagaatagcaggtcagaggctcctaactgggcaactcaagattctggcttctactgaagaccataaagaaaagatg

SEQ ID NO: 12546 - DNA, 387 bp, Homo sapiens
tgatcaagtgttacttatctaataatcctctagaaagaaccctgttagatcttggtttgtgataaaaatataaagacagaagacatgaggaaaaacaaaagggttgaggaaatcaggcatatgactttatacttaacatcagatcttttctataatatcctactactttggttttcctagctccataccacacacctaaacctgtattatgaattacatattacaaagtcataaatgtgccatatggatatacagtacattctagttggaatcgtttactctgctagaatttaggtgtgagattttttgtttcccaggtatagcaggcttatgtttggtggcattaaattggtttctttaaaatgctttggtggcacttttgtaaac

SEQ ID NO: 12547 - DNA, 342 bp, Homo sapiens
  misc_feature 313: n = A,T,C or G
tacaaataaaatgtttaagatatatgcagggccaggtgtgatggctcatgcctgtaatcccagcactttgggaggccgaggcaggcagatcacctaaggtcaggagtttgagaccagcctggccaacgtggtgaaacctcatttctactaaaaatacaaaaaactagcagggcgtggtgacgggcacctgtagttgcagctactcaggaggctgaggcagaaaaatcgcttgaacctgggaggaggaggttgcagtgagccgagatcgcgccattgcactccaccctgggagacaagtgaaactccatctcanaaaaaaaaaagatatatgcggaagtattg

SEQ ID NO: 12548 - DNA, 280 bp, Homo sapiens
gggcagaaagaagtatttccaacctagaaattctatatatacccagcgaaaatatctcttaaaaagatatccaaggctgggcgtgacggctcacgcctataatcccaatactttgggaggccaaggcaggtggataacctgaggtcaggagttcgagacaagcctggccaacatggagaaaccctgtctatactaaaaatacaaaaattatcccggcgtggtggcatgtgcctgtaatcccagctactagggaggctgaggcaggagaatcacttgaatc

SEQ ID NO: 12549 - DNA, 270 bp, Homo sapiens
ggatcccctgcgtggctgggctgctcgggttagatcggcaggaaaagcctaaagattagactgtaagaaaagaaaatagaagccatgtttcgaagacctgtgttacaggtacttcgccagtttgtaagacatgagtccgaaacaactaccagtttggttcttgaaagatccctgaatcgtgtgcacttacttgggcgagtgggtcatgacctgtcttgagacacgtggaaggaaaaaatccagccacaatattttctctagcaactaatg

SEQ ID NO: 12550 - DNA, 517 bp, Homo sapiens
ggtcgaccggcgggaagatggcggacattcagactgagcgtgcctaccaaaagcagccgaccatctttcaaaacaagaagagggtcctgctgggagaaactggcaaggagaagctcccgcggtactacaagaacatcggtctgggcttcaagacacccaaggaggctattgagggcacctacattgacaagaaatgccccttcactggtaatgtgtccattcgagggcggatcctctctggcgtggtgaccaagatgaagatgcagaggaccattgtcatccgccgagactatctgcactacatccgcaagtacaaccgcttcgagaagcgccacaagaacatgtctgtacacctgtctccctgcttcagggacgtccagatcggtgacatcgtcacagtgggcgagtgccggcctctgagcaagacagtgcggctcaacgtggtcaaggtcaccaaggctgccgggcaccagaagcagttccagaagttccaaggctggacatcggcccgctcccc

SEQ ID NO: 12551 - DNA, 82 bp, Homo sapiens
acaggaatatattacctatatacaaagtattatttaacaaccttgtattttagtcatacatctttaaccgtattagatttaa

SEQ ID NO: 12552 - DNA, 80 bp, Homo sapiens; identical to SEQ ID NO: 4177

SEQ ID NO: 12553 - DNA, 149 bp, Homo sapiens
atgacccaccaatcacatgcctatcatatagtaaaacccagcccatgacccctaacaggggccctctcagccctcctaatgacctccggcctagccatgtgatttcacttccactccataacgctcctcatactatgcctactaaccaa

SEQ ID NO: 12554 - DNA, 56 bp, Homo sapiens
gatgtaatccttgggtttctttctgcattctttccttcttttgagatatctcctgt

SEQ ID NO: 12555 - DNA, 323 bp, Homo sapiens
gaagtctcaaggttctatttttaagataatccaaagtgatgggctgggtgcagtggctcacacttgtaatcccagcactttgggaggccgaggtgggcggatcacttgaggttaggagttggagaccagcctggccaacatggcaaaatcttgtctctactgaaaatacaaaaattagctgggtgtggtggcggtcctctgtagtcccagctactcgggaggctgaggcaggagaatttcctgaacctgggaggcagaggttgcagtgagctgagattgtgccactgcacttcagcctaggtgacagagggagactccatcac

SEQ ID NO: 12556 - DNA, 159 bp, Homo sapiens
tataaacatatcattagaaaaatgtagataggaggccgggcgcagtggctcacgcctgtaatcccaacattttgggaggccgaggtgggtggatcacgaggtcaggagatagagaccatcctggctaacacggtgaaaccccatctctactaaatatac

SEQ ID NO: 12557 - DNA, 418 bp, Homo sapiens
tcttacataaagaagtccagggttggacgtggtggctcacgcctgtaatcccagcactttgggaggccgaggcgggtggatcatgacgtcagcagatcaagaccatgctggccaacatggagaaaccccgtctgtactaaaatacaaaaaattagccaggcgtgatgctgagcacctatagtcatgctatttgggaggctgatgcctgggaatcacttgaacccaggaggcggagattgcaatgagccaagatcacaccagtatacgccagcctggcaacagagcgaaactccgtctcaaaaaaaatatctccgaatattaaaaagtctagaggtggccaggcacggtggctcatgcctgtaatcccagcactttgggaggccaaggtgggtggatcacaacgtcaggagttcaagac

SEQ ID NO: 12558 - DNA, 93 bp, Homo sapiens
ggtgtcccagatgtagtattcccacaggggtctggcaggcccctcctgtaaccactccagtcacattttctgctcttgaggcagaggtgacat

SEQ ID NO: 12559 - DNA, 249 bp, Homo sapiens
accccgtctctactaaaaatacaaaaattagctgggtgtggtggcacacacctgtagtcccaactactcgaaaggctgaggcaggagaatcaattgaacccaggaggcagaggttgcagtgagccaagattgcgccactgcactctagcctggcaacagagactccgtctccaaaaaaaaaaaggggtttttgaagagggaccaaaattccttttttaaaaaaaaattccttttttaaaatttaagggg

SEQ ID NO: 12560 - DNA, 238 bp, Homo sapiens
ggaaacatggcactgttgcctatcagaagtcaattcaaaggacctgcccccagagagacaaaagatacagatattgtggatgaagccatctattacttcaaggccaatgtcttcttcaaaaactatgaaattaagaatgaagctgataggaccttgatatatataactctctacatttctgaatgtctgaagaaactgcaaaagtgcaattccaaaagccaaggtgagaaagaaatgt

SEQ ID NO: 12561 - DNA, 353 bp, Homo sapiens
ggcctcccaaagtgccaggattacaggtgtgagcctccacatccagcccattcattattacttttattacttattaggcaattttccaaaacaaaagctagaaatcaggccaggcacagtggctcatgcctgtaatcccagcacttagtgaggctgaggcaggaggatcacttgaggtcaggagttcaagaccagcctggccaacatggtgaaaccccatctccactaaaaatacaaaattagccaggtgtagtggtgggcgcctgtaatcccagctactcaggaggctgaggcaggagaatcacttgaacctgggaggcagaggtagcagtgagccgagatcgtgcgactgg

SEQ ID NO: 12562 - DNA, 386 bp, Homo sapiens; identical to SEQ ID NO: 4192

SEQ ID NO: 12563 - DNA, 528 bp, Homo sapiens; identical to SEQ ID NO: 4197

SEQ ID NO: 12564 - DNA, 135 bp, Homo sapiens
acctggaggcgtctgcagagtgtgcgcagttcttcagtatttagagcatcgatcctgcggtgatactcagccactgacactacctaaatatggagacaggaagacaataattccactgacagttgagaaaaacag

SEQ ID NO: 12565 - DNA, 77 bp, Homo sapiens
gtggtgcacagaggctgcagtgagtggagatcgcaccattacactccagcccgggcgacagtgcgagactccatctc

SEQ ID NO: 12566 - DNA, 494 bp, Homo sapiens
ggttatttagctgtttgcgataaatcttgatactgttcactctttgggtccacactgcctttatgagctgtaagactcaccatgaaggtcttcagcttcactcctgaagccatcgagaccacgaacccaccaggaggaatgaacaactccagaggcgccgccttaagagctgtaaaactcatggcgaaggtctgcagcttcacacctgagccagcaagaccacgaacccaccagagggaagaaactcagaacacatccgaacatcagaaggaacaaactctggacatgccgcctttaagaactgtaacactcaccgcgagggtcggcggcttcattcttgaagtcagtgagaccaagaacccaccaattctagacacaagaggatttggtggggaagacagaggaaatgggaagcccctaagttaggaatacgcttggcaagtccaaggagcagcaaggtgtccactgtggctgcagcagcatgagtaagggag

SEQ ID NO: 12567 - DNA, 820 bp, Homo sapiens; identical to SEQ ID NO: 266
  misc_feature 543, 662: n = A,T,C or G

SEQ ID NO: 12568 - DNA, 476 bp, Homo sapiens; identical to SEQ ID NO: 4200

SEQ ID NO: 12569 - DNA, 437 bp, Homo sapiens
tctcactggcagctgcatctggtggcgccaaggagctaaagaacatccacgtgtgcctgggtggcctgttcgtgcctgaggcgtacatcactgccaccaggcagtatgtggcccaggccaacagctggtccctggaggagctctgcctggaagtcaacgtcaccacctcacagggcgccacccttgacgcttgcagcttcggagtcacgggtttgaaacttcaaggggccacgtgcaacaacaacaagctgtcactgtccaatgccatctcaaccgcccttcccctgacgcagctgcgctgggtcaagcagacaaacaccgagaagaaggccagtgtggtaaccttacctgtctacctgaacttcacccgtgcagacctcatcttcaccgtggacttcgaaattgctacaaaggaggatcctcgcagcttctacgag

SEQ ID NO: 12570 - DNA, 322 bp, Homo sapiens
  misc_feature 235, 322: n = A,T,C or G
gtggatcatgaggtcaggagatcgagaccatcctggctaacaaggtgaaaccccatctctactaaaaatacaaaaaattaaccgggcgcggtggcgggcgcctgtagtcccagctactcgggaggctgaggcaggagaatggcgtgaacccgggaagcggagcttgcagtgagccgagattgcgccactggcagtcgcagtccggcctgggcgacagagcgagactccgtctcanaaaaagaaaaacaaaacaaaacaaaaatgagactgggcgtggtggctcacactttgggattccaaaagtgaggaataatcccaacan

SEQ ID NO: 12571 - DNA, 485 bp, Homo sapiens; identical to SEQ ID NO: 4218

SEQ ID NO: 12572 - DNA, 370 bp, Homo sapiens
ctcactcttgtcacccaggctggggtgcaatggcgtgatcttggctcactgcacgctccgcctcccgggttcaatgattcccctgcctcagcctcccgagtagctgggattacaggtgcctgccaccatgcccagctaatttttgtatttttagtagagacaggtttttgccatgttggccaggctggtctcgaactcctgacctcaggtgatctgcccgcctcggcctcccaaactgctgggattacaggcgtgagccaccatgcctggccagcttatcaaaactttaaggagtactgaaaatcatttagaagttagtaagttatagtctttatacaaaaaagagtcaagtgttcatgttgtataacta

SEQ ID NO: 12573 - DNA, 246 bp, Homo sapiens
tttctacgggtgccaaaagactacagaagggggagcggagcccggagcgtcgtggaaagcattggacacatttccaccatgctaatggcattttaaatatatttggcaattttcccaattttttactgaagaaaacggtgagtttatacttgaggactgaagtgtgactctgccgattatcaagctttcaagaagaatctggaaaaactcaccaagcctgaactcctgacactatttattattctt

SEQ ID NO: 12574 - DNA, 332 bp, Homo sapiens
gaaggggagaccctgtctcaaaaaggaaaaaaaaataaaaaggccgggcatggtggctcatacctgtaatcccagcactttgggagactaaggcaggcggatcacttgaggtcaggagtttgaggccagcctggtcaacctggtgaaacctcatctctaagaaaaatacaaaaattatccaggcgtggtggcaggaacctgtaatcccagctactcaggaggttgaggcaggagaatcacttgggcctaggaggtagaggttgcactgagccaaaattgcaccactgcactctaacctgggcaacagagcaagactcctcaaaaaaaaaagg

SEQ ID NO: 12575 - DNA, 340 bp, Homo sapiens
gctggtgctctagggtgagctctgcccggctgcagggatggcggggaggggtaagctcatcgcagtgatcggagacgaggacacggtgactggtttcctgctgggcggcataggggagcttaacaagaaccgccatcccaatttcctggtggtggagaaggatacaaccatcaatgagatcgaagacactttccggcaatttctaaaccgggatgacattggcatcatcctcatcaaccagtacatcgcagagatggtgcggcatgccctggacgcccaccagcagtccatccccgctgtcctggagatcccctccaaggagcacccatatgacgccgcg

SEQ ID NO: 12576 - DNA, 482 bp, Homo sapiens; identical to SEQ ID NO: 4234

SEQ ID NO: 12577 - DNA, 329 bp, Homo sapiens; identical to SEQ ID NO: 4236
  misc_feature 228, 229, 230, 231, 232, 233, 234, 235, 236, 237, 239, 241,242, 243, 244, 245, 246, 247, 248, 249, 251, 252, 253, 254,255, 257, 259, 262, 263, 264, 265, 266, 267, 268, 269, 271,272, 273, 274, 275, 276, 278, 279, 280, 281, 283, 284: n = A,T,C or G
  misc_feature 286, 292, 294, 295: n = A,T,C or G

SEQ ID NO: 12578 - DNA, 303 bp, Homo sapiens
aatgactcagtgagttttctcatttataaaataggatgtttcctcccagggtgggggtgaagtgggtgagatgacccatttgaagcacagtggacccttgaacaatgcaatggttgggcagtcaattcacataaaacttttgatctgagttgggcagatcacctgagattaggagtttgagaccagcgtgaccaacatggagaaaccctgtctctactaaaaatacaaaattagccgggcatggtggcacacgcctgtaatcccagctactcgggaggcagaggcaggagaatcacttgaacc

SEQ ID NO: 12579 - DNA, 102 bp, Homo sapiens
cagaagggtgacaaccagggtgcaggagaacaaggtagaccagtgaggcagaatatgtatcggggatatagaccacgattccgcaggggccctcctcgccaa

SEQ ID NO: 12580 - DNA, 339 bp, Homo sapiens
  misc_feature 339: n = A,T,C or G
ggggcttgttcgctggtggcgtcggagccgagccggactggtcaggatgatcacgggcgtgcagctcgccatcttcgccaacatgctgggcgtgtcgctcttcttgcttgtcgttctctatcactacgtggccgtcaacaatcccaagaagcaggaatgaaagtggcgctttctccgccccagggttccgggacatagtctgaggcaagatggagggtatgaggggccttcacacttcacttcatcccttctacccatcacaacatacaaagcaactacacctggatttttccaaacaacttttatttcctcagagtcttccttaatcctatggaacan

SEQ ID NO: 12581 - DNA, 277 bp, Homo sapiens
gatttgtggtgagattctctcccaggccacaagacatttcctgctcggaaccttgtttactaatttccactgcttttaaggccctgcactgaaaatgcaagctcaggcgccggtggtcgttgtgacccaacctggagtctgtcccggtcccgccccccagaactccaactggcagacaggcatgtgtgactgtctcagcgactgcggagtctgtctctgaggcacattttgtttcccgtgccttgggtgtcaagttgcagctgatatgaatgaatgc

SEQ ID NO: 12582 - DNA, 381 bp, Homo sapiens; identical to SEQ ID NO: 4246

SEQ ID NO: 12583 - DNA, 233 bp, Homo sapiens
gcctatcccacttcacaggtgaggcatggcaattctggaagctgattaaaacacacataaaccaaacaacaggcccttgggtgaaaggtgctatataattgtgaagtattaagcctaccgtatttcagccatgataagaacagagtgcctgcattcccaggaaaatacgaaaatcccatgagataaataaaaatataggtgatgggcagatcttttctttaaaatataaaacg

SEQ ID NO: 12584 - DNA, 360 bp, Homo sapiens
ttcattatccagttctattgagtcatttagcaatatttcttacaatatttcaatcagcttccaaatattttaaaaatctacctcttaaaaattaatttctggctggcgtggtggctcacgcttataatcccaacactttgggaagctgaggcaggcagatcacctaaggtcaagagttcgagtccagcctggccaacatggcgaaaccctgtctctactaaaaatacaaaaattagccgggcatggtggcaggcgtctgtaatcccagctactcgggaggctgaggtagggagaattgcttgaacccaggaggtggaggtttcagcgagccgagattgcaccactgcactccagccctgg

SEQ ID NO: 12585 - DNA, 878 bp, Homo sapiens
cctgttgctgagctgcttttctgaattcctctggtgctgccttggctattccctgatccggtaatgctccatatttccgatgttgctcataccagtcactcaccgtcatagttggcagacttggataaccagctccaaatactttggcttgagccatgttccgagtgagaatgaagggtttcactggaggcctctcctggcgagatgagttagaagttgatgcctctcttgaagagtctctttctctcaggatctttatttcctggtcaatgctctcaatctcttctaagctgatatcaatccacctctgaaggtgaagaagataatattcacgaacacgctcatcatctgcttgaccactttccacagcagatttcattgcagacaacctatgctccaactccttcttctgcttgtatctctgtattttagcctgtctttgagatgccatagcaacgagactaggataagccatggaggaattggcagtgtgattttcagcagagttgttcatggttttgggcagctcaaactctgccacatgatagcaatggcactgagttaagtagtttatacagtgttctcgagccccgctgcaaatgatctagactcctgctggggttgacttgtttcaatgggaggggctccttgaaaagcctggaccccaaaaggtaatcaagtgcgtgggggacaaatctttccaaaatctacattcgcggccgaacaaggtggactgggaataacatttcggcagccctcctcaaggaggtccaaagcccttgaacacttcctccgggactatcccggaaacggcggggtcaagtcgccacttctacttcctccagtaactgtctacagtttccgaacagctcggggac

SEQ ID NO: 12586 - DNA, 533 bp, Homo sapiens
atacttttagtgtattattaagcaaatattaatttaatcatataaaccaatcctggtcagcaaaaagcactgttagctgccatgtaaaggtccttctgtcaagtaaaacttcattctacacttctagcttcctatcagaggaacttcttgaaggaactctttcagttggctttacaactcatctgcaacaccaaatgtggattaaattcagatcacaccttggttgtgtatatatgtatataacagcccctggcacaattagctaatatcttgtaattgtaaacgaattgttctcttttagccatttcccccccatttcctataacggtctttatccaaatgctttggtgctccataagtaactgtgagtcagaggtgcctcagtgctggagatgcctgtcacagagaagatcagaatgtgtgaagataaccctgcattacgttcatctcatcagttctgtccaatccacaggggtaaaaaatggatgagatttgatattctcaacacccagcactccagcaccaagtcgttc

SEQ ID NO: 12587 - DNA, 227 bp, Homo sapiens
  misc_feature 139, 140, 141: n = A,T,C or G
attaatcccctggcccaacccgtcatctactctaccatctttgcaggcacactcatcacagcgctaagctcgcactgatttttttacctgagtaggcctagaaataaacatgctagcttttattccagttctaaccaannnaaaaaaaaaaaaaaaaaaatttttgggggcggttttttccgtaatcccaaccttgataaaaaccttggtggagttgggacaacccc

SEQ ID NO: 12588 - DNA, 319 bp, Homo sapiens
gaacatagaaaagaaaattaagactgtgtttcagggctgggcatggtggctcacacctgtaatcctagcactttgggaggccgaggtgggtagagcaccacaggtcaggagttcaagattagcccagccaacatggtgaaatctcgtctctactaaaaatacaaaaattagttgggcgtggtggtggccacctgtaatctcagctactcaggaggcagaggcaggagaattgcttgaacctgagaggtggaggttgcagtaacctgagatggtgccatcacactccatactgggcaacaagagtgaaactctgtctcaa

SEQ ID NO: 12589 - DNA, 395 bp, Homo sapiens; identical to SEQ ID NO: 4271

SEQ ID NO: 12590 - DNA, 353 bp, Homo sapiens
gggaggttggcgaggctttgctgaaagctagcaaaccgagcgatcatgtcgcacaaacaaatttactattcggacaaatacgacgacgaggagtttgagtatcgacatgtcatgctgcccaaggacatagccaagctggtccctaaaacccatctgatgtctgaatctgaatggaggaatcttggcgttcagcagagtcagggatgggtccattatatgatccatgaaccagaacctcacatcttgctgttccggcgcccactacccaagaaaccaaagaaatgaagctggcaagctacttttcagcctcaagctttacacagctgtccttacttcctaacatctttctgata

SEQ ID NO: 12591 - DNA, 325 bp, Homo sapiens
gagggctcactgagaaccatcccggtaacccgatcaccgctggtcaccatgaaccacattgtgcaaaccttctctcctgtcaacagcggccagcctcccaactacgagatgctcaaggaggagcaggaagtggctatgctgggggtgccccacaaccctgctcccccgatgtccaccgtgatccacatccgcagcgagacctccgtgcctgaccatgtggtctggtccctgttcaacaccctcttcatgaacacctgctgcctgggcttcatagcattcgcgtactccgtgaagtctagggacaggaagatggttggcgacgtga

SEQ ID NO: 12592 - DNA, 237 bp, Homo sapiens
aagtgacttgctcaaagtctcactgttactcagtggcaaaacaagactagaatttgggtttcctggtccataacctgtcactttcttttttcttaactacaatacctcctttatgaagaccttcataaattctaggatggtgaattctcctttattttgtgtgtcgtgtgcaagtggacatgtgtgtatttactaaactctgtggacctggaaatacattctgatatgactatcaac

SEQ ID NO: 12593 - DNA, 464 bp, Homo sapiens
tacacctataatcctagcattttgggagaccaagatagggggctcacttaacgccaagattcgagaccagcctgaccaacatagtgaaaccccatgtctactaaaaatataaaaattagctgggtgtggtggcacgcgcctgtaatcccagctacttggaaggctgaggcaagagaatcgcttgaacccgggaggcataggttgcagtgagccaagatcgcaccactgcactccagcatgggtgacaaagcgagactccatctaaaacaaaagaaaagaaatagaaatttgatagtataaaaatctaagtattcctttggtagcagatagatcttaatgccatgttggtgagacattgggaattagagtttatttttaggctgggcatggtggctcattcctgtaatcccagcactttgggaggctgaggcgggtggatcacctgacgtcaggagttggagacc

SEQ ID NO: 12594 - DNA, 511 bp, Homo sapiens
gtgagcctagatcacgccattgcactccagcctgggtggcagattaagacttcatctcaaaaaaataaataaataggccgggcgcggtggttcacgcctgtaatgccagcactttgggaggccaaggcaggtggatcacctgaggtcaggagttcaaaaccagcctgaccaacatggagaaaccccatctctactaaaactacaaaattagctgggcatggaggcgcatgcctgtaaccccagctactcaggaggctgagacaggagaatcgcttgaacccgggaggtgaggctgcagtgagccaagatggtgccattgcactccagtctgggcaacaagagtgaaactccatctcaaaaaataaattaattaatttcattaaattaaataaatagttttaaccaattatatgttgaagtgatcatacattgtgtatactggctttagaaatatattaccaaagttaggctgggcacggtggctcaggcctgtaatcccagcactttggga

SEQ ID NO: 12595 - DNA, 516 bp, Homo sapiens
gaacctccatttttactcttgacagggcactgcaaacataaacattagagctaaagactgtatgtataaaaatctcagctgggcacagtggctcacatctgtaatcccagcactttgggaggccaaggcaggcggatcacctgaggtcaggagtcggagaccagccaggccaacatggcgaaaccctgtctctactaaaaatacaaaaaaattagctaggtgtggtggcaggcgcctgtaatcccagctgaggcaaaagaattgcttgaacccagaggcagaggttgcagtgagccgagaacacgccattgcactccagcctgggtgacaagagtgaaactccatctcaaaaaacaaaaaacgagaacaacaacaacaacaaatctctgagtgttttctctgcatatttgttaatgtaaaaattgtatttggaatctctgcattagaattctgaaatttcagtaataaaatcagcgatttctttgaatggcatatattggctatttatcagggaat

SEQ ID NO: 12596 - DNA, 516 bp, Homo sapiens; identical to SEQ ID NO: 12595

SEQ ID NO: 12597 - DNA, 356 bp, Homo sapiens
ctgttttgtaaggggacattttgtaggttctagggtgttgggtatggtgctggcatttagttatcttcatcagagatcaggtatccacatagctacactagacggcgttggatctatctgccatcttgtcaaggcagcagagttgtgttaagaaaacatttttggagtcagatgtgtttcaaattccaactattattccctgcatccatttctctcattttaagataggagcttatattgtttacctaacagtgtatatggtataaaaattaatagtttaagtgcattggacgtattattatatacataataaattctctgcaactactactatcttccctttcctggtggatcat

SEQ ID NO: 12598 - DNA, 332 bp, Homo sapiens
gggctaccccggctactcctgctcagcatggctgctttagtgactgttctcttcagtgagtggcaggtgtccggaggctgcactgcagcgcagccgcttgggcgggcggccagtggcgactacagcagggactggctgccaacccctccggctacgggccccttaccgagctcccagactggtcatatgcggatggccgccctgctcccccaatgaaaggccagcttcgaagaaaagctgaaagggagacgtttgcaagacgagttgtactgctgtcacaggaaatggacgctggattacaagcatggcagctcaggcagcagaagttgcag

SEQ ID NO: 12599 - DNA, 360 bp, Homo sapiens
  misc_feature 72, 218, 360: n = A,T,C or G
gaggggactccgggaggaggaacatggcggtggcggacctcgctctcattcctgatgtggacatcgactccnacggcgtcttcaagtatgtgctgatccgagtccactcggctccccgctccggggctccggctgcagagagcaaggagatcgtgcgcggctacaagtgggctgagtaccatgcggacatctacgacaaagtgtcgggcgacatgtanaagcaaggctgcgactgtgagtgtctgggcggcgggcgcatctcccaccagagtcaggacaagaagattcacgtgtacggctattccatggcctatggtcctgcccagcacgccatttcaactgagaaaatcaaagccaagn

SEQ ID NO: 12600 - DNA, 140 bp, Homo sapiens
acagaagtgaattcttccaaatttatgaaaatgaacacttagctaaaatgtgttcactgggttatgacaagtaactgggcttctagggaatgggatggcaggtggggtgctatcagtttataaaattttttgtaacctcg

SEQ ID NO: 12601 - DNA, 382 bp, Homo sapiens
ccgggtagctgggattacaggtgcgtgccaccacgcccggctaattctttgtatttttagtagaggctgggtttcaccatgttagccaggatggtctctatctcctgaccttgtgatccacccgcctcggcctcccaaagtgctgggattacaggtgtgagctacggtgcccagcctaattttcatatttttagtagagacggggtttcaccacgtagttcaggctggtctcgaactcctgacctcgtgatctgcccacctcgtcctcccaaaatactgggattacaggggtgagtcaccacgcctggcaagaaaactttttaatggtcctaggggcaagtataaattttctaggacctagaagacaacgctgtcattgctt

SEQ ID NO: 12602 - DNA, 804 bp, Homo sapiens; identical to SEQ ID NO: 2885

SEQ ID NO: 12603 - DNA, 658 bp, Homo sapiens
  misc_feature 569, 592, 593: n = A,T,C or G
gaggaagggtgagggaaaaatctcaacagaagcaagtttggggaaaatctggagtccccagtaaaaagcaggaaggtctctgctgtactcatcacagaatgggagagagggctctcaatagatcattccctttgtttctcccctgggcttcttgagcttctcgaagttcttcaggatgatgtcatataacacagcataagcattgcggatctccatgaccatcagccggatgtcccggtactctgcctcatccagctcgtgcaccagctgccgataatcacccacatggggctgcttggctgctttagtcactgcatcaccacgctcagagaaatacttagagatttgagtgtggaagccttctagcttggtgtggaggctggtcatcagctcaaacaccttctcctggacagccactccaaaattgttaccatcctcaatccgaggtatctgcagctgcaaccaggtggtgaccaggttgagctgctcaatgacatccttgatctcaggcttcaagcgctgcagaagggacacgatcttttcattgcaagtcactggggcacagggangaccctttgtctcaatctcaccnntcttctttcatcctggcttcatctcctgctggttcttcagtcctcttctcttcatcttgactggg

SEQ ID NO: 12604 - DNA, 478 bp, Homo sapiens; identical to SEQ ID NO: 1126

SEQ ID NO: 12605 - DNA, 529 bp, Homo sapiens
gacgctcggtaccaggcgcagatcatggcaggcagccggctggaaaccgtagggagcatcttctctcggactcgggacctggttcgggccggggtgctgaaggagaagcccctgtggtttgacgtatatgacgcctttcccccgctgagggagcccgtcttccaaaggcctcgagtgcgatatggcaaagccaaagctcccatccaagacatctggtaccacgaggatcggattagagcgaagttttattcagtgtatgggtctggtcaaagagcttttgatctattcaatccaaacttcaagtctacctgtcaacggtttgtggagaagtacactgagctacagaaacttggagaaacagatgaagagaagttatttgtggaaacagggaaggctttattggcagaaggtgtcattttaagacgagtaggcgaagcaaggactcaacacggaggtagtcacgtttcccggaaatccgaacacttgagtgtcagaccacagactgcgttggaagaaaacgagactcaga

SEQ ID NO: 12606 - DNA, 483 bp, Homo sapiens
acagaaggggtgctgcatgtttaaagtattccctctgttttacttcatgatagttggcccctttcaggttataacacggacatttttctatggttttcattatttgcacatgccaacagagtagaatagatttttaacgagcatcacttcattgcaagcaaatttattaatccagtggtactgatgaaactaaggagctctttggggtcaggctcgatggctcacgcctgtaattcttgcactttgggaggctgaggcgggtggatcacaaggtcaggagttcaagaccagcctggccaagatggtgaaaccctgtctttactaaaaatacaaaaaaattagccgggcatggtggcgggtgcctgtaatctcagctactcgggaggctgaggcagagaattgcttgaaccgagggggaggcggaggttgcagtaaaccaagatcgcaccactgcactccagcctaggtgatagagcgagactc

SEQ ID NO: 12607 - DNA, 613 bp, Homo sapiens
aggacctgtcccaaagaaaaagctctttttttagccagcatatttccccttctacccttttactttgttgttctgattttaggactctggctggccatgtgcttgtggttgcctctcctgcatttgccactggatttgcactgcatcgtttggagatacaaagcgagcagttcttggtcagaaccctcctctgcttttcattgtgtttgataatggttactgggtccttctctcaagggtagcaaggccaagctgatggctgcttgtttaggaggccatcagttccttcctgtggagaagggtctgaaatggaagtcagtggtagaaggggctggtctgctgggcagggcttacatccactgagttctaagattcctttcctgatctgcacctacgcctggtctgtatggtggaatttgtcagctggaactcagaaacaacaacttgaaaaaaaaataataattagaacatatttgcataagatagctatttactctggaaaccaacaacttttgagatttcccttgccctgtggacgcccagctcctgtcatccttccttaggtcctgcagtacagtcttcccctgaatgccaccggggacccagggggact

SEQ ID NO: 12608 - DNA, 515 bp, Homo sapiens
tttttttttttttttttttttttttaccattctcttttagtctatgggaattacagggttgccgctaaaatattcacttgttcatatcgtgtcagagatttcctcttctctggagcttaggtggctcttcacaatccataggcttgaatctgcaacctagtgtaaactgccttgctttccccggttctttcccctgctagcacctgctttctcatccctatctccagtcaaagatgggattacttaatccaactctggagagggaccaagtcttttctgcccacatctcacacaattgaggtgtctgaacaagcttggggagggtctataaggggtaggctcaaaaaaaaaaaaacccatctgcagagggcagttttgccaacacaagggctctttcaagccgactttcacaaagagagccggacttgttagttggcttctgtctctttagagccaagaaaatagtaattaagtggcctagatataggaagggcagaataagcacttactccccc

SEQ ID NO: 12609 - DNA, 591 bp, Homo sapiens
cacggggctgctgtaaggccgaggttgcggcgggagcggagaccatgttccgagcggcggctccggggcagctccggcgggcggcctcattgctacgatttcagagtaccctggtaatagctgagcatgcaaatgattccctagcacccattactttaaataccattactgcagccacacgccttggaggtgaagtgtcctgcttagtagctggaaccaaatgtgacaaggtggcacaagatctctgtaaagtagcaggcatagcaaaagttctggtggctcagcatgatgtgtacaaaggcctacttccagaggaactgacaccattgattttggcaactcagaagcagttcaattacacacacatctgtgctggagcatctgccttcggaaagaaccttttgcccagagtagcagctaaacttgaggttgccccgatttctgacatcattgcaatcaagtcacctgacacatttgtgagaactatttatgcaggaaatgctctatgtacagtgaagtgtgatgagaaagtgaaagtgttttctgtccgtggaacatcctttgatgctgcagcaacaagtggcggtagtg

SEQ ID NO: 12610 - DNA, 485 bp, Homo sapiens
taagatttgccgagttccctttactttttttaacctttccttatgagcatgcctgtgttgggttgacagtgagggtaataatgatgttgaaagttgatgaacagtgtggtatccctactcttgatcctggaaccagacaagcaagaagctttgattgaaagcctatgtgaaaagctggtcaaatttcgcgaaggtgaacgcccgtctctgagactgcagttgttaagcaaccttttccacgggatggataagaatactcctgtaagatacacagtgtattgcagccttattaaagtggcagcatcttgtggggccatccagtacatcccaactgagctggatcaagttagaaaatggatttctgactggaatctcaccactgaaaaaaagcacacccttttaagactactttatgaggcacttgtggattgtaagaagagtgatgctgcttcaaaagtcatggtggaattgctcggaagttacac

SEQ ID NO: 12611 - DNA, 177 bp, Homo sapiens
gcgtgtgcactgtggaacagagctgagaccccggccccccttggactggcacagggtcctacagagtcagaggaggcctgagatttcgaatgggcagtgaatggcctcttctgccagccacaggcaggatgctccttgatcacggcatcccccggcggtagtacagggtgagcttgc

SEQ ID NO: 12612 - DNA, 466 bp, Homo sapiens
tcttttccgtggcgcctcggaggcgttcagctgcttcaagatgaagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggatgcattgtggatgcaaatctgagcgttctcaacttggttattgtaaaaaaaggagagaaggatattcctggactgactgatactacagtgcctcgccgcctgggccccaaaagagctagcagaatccgc

SEQ ID NO: 12613 - DNA, 519 bp, Homo sapiens
ctcttttaataaacaaaaccatccaaggtacagttccaaagtacaaaatcaaccaggtctgaactgattggtgataagagcacacagatcagtccttccttaaggaaacagtttcctccctgatgccctctttggtcactatgcagatccggagtgcgtccccagtgtacacatctctctcagccgcagaaatgaagacatctttcaccagccgcatggctctgtccaaggacagcggaacatgctccacattctgcatgttcttaaaaccaacctggttgtcaagcaggggctgtagcatggcacttgctgagcctccagccttgaaggagtctctctggtaagaccctactggatcaaagctgtatacagccccctttccttcttcatcaagtccaccgatgatgttgtaaacatagtatggaaagaagcgccttgaatacaggattgtagacagcattgcagcaattgcccccgtagtcatggccttattattggaatgcttatacatctttagtc

SEQ ID NO: 12614 - DNA, 404 bp, Homo sapiens
ttttttttttttttttttttttttccgacagggtagctgggattacaggcacctatcattcattctgcccagctaatatatattttttttttctgagacatgttggctaggctggtcttaaactcctgacctcaggtgatctgccaacctcggcctctcaaagtgctgggattacaggcatgagccaccgcccatggcctttgtctaatatttaaccagaggaatagtcccccaaccaaaagcaggagagaaaactggctttggacttgctagcaggtagtatctgtcctcaatgatgtaccaacataaagcatttttcataagtggttctggatgccctttcttggaattcacaccctcagattgagttgagattaaaatttaaagaacaagtaagcaaaata

SEQ ID NO: 12615 - DNA, 497 bp, Homo sapiens
ctcttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctgtggtggttccatgtgtgctaaatgtgttcgtgacaggatcaagcgtgctttccttatcgaggagctgaaaatcgttgtgaaagtgttgaaggcacaagcacagagtcagaaagctaaataaaaaaatgaaacttttttgagtaataaaaatgaaaagacgctgtccaatagaaaaagttggtgtgctggagctacctcacctcagcttgagagagccagttgtgtgcatct

SEQ ID NO: 12616 - DNA, 473 bp, Homo sapiens
tacggccgggtattttgtgctatggatgtgagtacggcaaagagactgaattaagctgttttgtatttggaatcggattgttcacgttgcaacgttgctgcaatgataaatggatggatactctttacactttgaagtggatttaatcttcactttaagccccttcatctcacctacacagcaggagagctttggctttgatatttggggaaatggctgttattttacttacagatcacgctattctagtcttggcctagttaaaagcaaatgagtactttagtttctacaagatttattggccactacttggtctgcacaaaagactataacacttggccggacgcggtggctcacgcctgtaatcctaccactttgggaggccgaggcgggcgaattgcctgagatcaggagttcgggaccagcttgggcaacatggtgaaaccctgtctctactaaaaatacaaaaaatt

SEQ ID NO: 12617 - DNA, 632 bp, Homo sapiens; identical to SEQ ID NO: 1166

SEQ ID NO: 12618 - DNA, 591 bp, Homo sapiens
tgccaaggcctgcgtagtacacggcagtgatctaaaggacatgacctccgagcagctggatgacattttgaagtaccacactgagatagtgtttgccaggacctcccctcagcagaagctcatcattgtggaaggctgccaaagacagggtgctatcgtggctgtgactggtgacggtgtgaatgactctccagctttgaagaaagcagacattggggttgctatggggattgctggctcagatgtgtccaagcaagctgctgacatgattcttctggatgacaactttgcctcgattgtgactggagtagaggaaggtcgtctgatctttgataacttgaagaaatccattgcttataccttaaccagtaacattcccgagatcaccccgttcctgatatttattattgcaaacattccactaccactggggactgtcaccatcctctgcattgacttgggcactgacatggttcctgccatctccctggcttatgagcaggctgagagtgacatcatgaagagacagcccagaaatcccaaaacagacaaacttgtgaatgagcggctgatcagcatggcctatgggca

SEQ ID NO: 12619 - DNA, 614 bp, Homo sapiens
actggcgctgtgcgcgctccatgcacgagttttccgccaaggacatcgacgggcacatggttaacctggacaagtaccggggcttcgtgtgcatcgtcaccaacgtggcctcccagtgaggcaagaccgaagtaaactacactcagctcgtcgacctgcacgcccgatacgctgagtgtggtttgcggatcctggccttcccgtgtaaccagttcgggaagcaggagccagggagtaacgaagagatcaaagagttcgccgcgggctacaacgtcaaattcgatatgttcagcaagatctgcgtgaacggggacgacgcccacccgctgtggaagtggatgaagatccaacccaagggcaagggcatcctgggaaatgccatcaagtggaacttcaccaagttcctcatcgacaagaacggctgcgtggtgaagcgttacggacccatggaggagcccctggtgatagagaaggacctgccccactatttctagctccacaagtgtgtggccccgcccgagcccctgcccacgccctcggagccttccaccggcactcatgacggcctgcctgcaacctgctggtggggcagacccgaaatccagcgtgcaccc

SEQ ID NO: 12620 - DNA, 543 bp, Homo sapiens
tgctcgacttggacgaggagcttcgctacagcttggctacctccagggccaagatgggtcgccgagctcaacaggagtcagcgcaggccgagaatcacctcaatggcaagaattcctctttgactctgactggagagacttcctctgctaaattacctcgctgccgacagggaggctgggcaggtgattccgtgaaggcttcgaagtttaggaggaaggcttctgaagaaatagaagatttccgcctcagaccacagagcctgaatggatcagattatggaggagatattcctatcattccggatctggaggaagtacaggaagaagactttgttttgcaggtggcagcccctcccagcatccagataaagcgggtgatgacctaccgtgacctggacaatgacctcatgaagtactcagccattcagacactggatggggagatcgacctgaaactcctcaccaaagtgctcgcgccggagcacgaagtccgggagcgaaacccttcttgcaggatgatgtcggctgggactgggatcatct

SEQ ID NO: 12621 - DNA, 408 bp, Homo sapiens
ttatcttgaagttggcttcgcgcttagatgctttcagcgcttatccattccgtacatagctaccgggccatgcccttggcagaacaactggtacaccagaggtacctccatcccggtcctctcgtactaaggacaggtctcctcaaatttcctacccctgcgacggatagggaccgaactgtctcacgacgttctgaacccagctcgcgtaccactttaatgggcgaacagcccaacccttgggacctactacagccccaggatgtgatgagccgacatcgaggtgccaaacctccccgtccatgtggactcttgggggagataagcctgttatccccagggtagcttttatccgttgagcgatggcccttccatgcggaaccaccggatcactaagtccgactttcg

SEQ ID NO: 12622 - DNA, 230 bp, Homo sapiens
tttttttttttttttttggcctatttcagatttattaaaaaacacataggtaacgagtcagagctttggctaggaatgatttggaaaagaactgaaggcatagttccacaggacattcacagttgtgtgctagagacagagaggagcaggaaagtgttttagaagcatttgcggtggacaatggaaggcccggcttcatcgtattcctgtttgctgatccacatctgctg

SEQ ID NO: 12623 - DNA, 497 bp, Homo sapiens; identical to SEQ ID NO: 1193

SEQ ID NO: 12624 - DNA, 534 bp, Homo sapiens; identical to SEQ ID NO: 1206

SEQ ID NO: 12625 - DNA, 531 bp, Homo sapiens
agaccaaccgcctgcaggaggctctgaacctcttcaagagcatctggaacaacagatggctgcgcaccatctctgtgatcctgttcctcaacaagcaagatctgctcgctgagaaagtccttactgggaaatcgaagattgaggactactttccagaatttgctcgctacactactcctgaggatgctactcccgagcccggagaggacccacgcgtgacccgggccaagtacttcattcgagatgagtttctgaggatcagcactgccagtggagatgggcgtcactactgctaccctcgtttcacctgcgctgtggacactgagaacatccgccgtgtgttcaacgactgccgtgacatcattcagcgcatgcaccttcgtcagtacgagctgctctaagaagggaacccccaaatttaattaaagccttaagcacaattaattaaaagtgaaacgtaattgtacaagcagttaatcacccaccatagggcatgattaacaaagcaacctttcccttcccccgagtgat

SEQ ID NO: 12626 - DNA, 581 bp, Homo sapiens; identical to SEQ ID NO: 2790

SEQ ID NO: 12627 - DNA, 566 bp, Homo sapiens
aggtgaacaagaaggaggtggtggaggctgtgaccattgtagagacaccacccatggtggttgtgggcattgtgggctacgtggaaacccctcgaggcctccggaccttcaagactgtctttgctgagcacatcagtgatgaatgcaagaggcgtttctataagaattggcataaatctaagaagaaggcctttaccaagtactgcaagaaatggcaggatgaggatggcaagaagcagctggagaaggacttcagcagcatgaagaagtactgccaagtcatccgtgtcattgcccacacccagatgcgcctgcttcctctgcgcctgaagaaggcccacctgatggagatccaggtgaacggaggcactgtggccgagaagctggactgggcccgcgagaggcttgagcagcaggtacctgtgaaccaagtgtttgggcaggatgagatgatcgacgtcatcggggtgaccaagggcaaaggctacaaaggggtcaccagtcgttggcacaccaagaagctgccccgcaagacccaccgaggcctgcgcaaggtggcctgtatt

SEQ ID NO: 12628 - DNA, 624 bp, Homo sapiens; identical to SEQ ID NO: 1224

SEQ ID NO: 12629 - DNA, 303 bp, Homo sapiens
ctggtgcctggaaatatttaccagtcaaggtcaaggtcaccatctgtggttaaaaatatagcattctgacctaaaaaagttattttgcagatgaatgtgttttcaactcaggacctatccaaatgaggaatttttaaatattcttttttttttcctatttttaaacatcaattctataaattctgactttttctaaccttttataggcttgccaaatgctggcaaaaaaaagtgctttttggatatggcagcacttgtaaaaataaagcagtaagcaaaatccttttaaacacaaaaatcctg

SEQ ID NO: 12630 - DNA, 628 bp, Homo sapiens
ggttacctcaaagaaattggaattaatgaagatcaatttcaagaagcatgcacgggtcctcttgcaaagacccatacatcacaggccattttgcaacctgtgttggcagcagaagattttactatctttaaagcaatgatggtccagaaaaacattgaaatgcagctgcaagccattcgaataattcaagagagaaatggtgtattacctgactgcttaaccgatggctctgatgtggtcagtgaccttgaacacgaagagatgaaaatcctgagggaagttcttagaaaatcaaaggaggaatatgaccaggaagaagaaaggaagaggaaaaaacagttatcagaggctaaaacagaagagcccacagtgcattccagtgaagctgcaataatgaataattcccaaggggatggtgaacattttgcacacccaccctcggaagttaaaatgcattttgctaatcagtcaatagaacctttgggaagaaaagtggaaaggtctgaaacttcctccctcccacaaaaaggcctgaagattcctggcttagagcatgcgagcattgaaggaccaatagcaaacttatcagtacttggaacagaagaacttcggcaacgagaacactatc

SEQ ID NO: 12631 - DNA, 530 bp, Homo sapiens
agtacatttcttacgctccgttaacacagagacaccaaaaacctggagggagttctgaagcaaataacaaggactattaaaagacttgaaggaatagtttataagggaaggattaagtcaaaggggaatgccatggcaatgggtagaaaacagtacaaaatatcctacaaagtaaaacaatgaggaaggggcaggaatgacttggggagaggaaacaaaaaaaccccaacaatgaagtaacttaaagtgcagaaaaaaaaaaattaaaactaattaagcagaaaaatgtaagccaaatggaggagtttgttgccacaaaataagtagtagtggggaaaaaaatatgtaacctccgaagagatattttcaagtgcacaagtgcaaaactctagtgcaagatttccttacactgcaggatggaaaatcatttacaaaaaacagggccaaaaaaatactgctaatggggatgctaataacaatattagttgtaggagcacttaacaagccgttgttttgtgccaggcactgtt

SEQ ID NO: 12632 - DNA, 249 bp, Homo sapiens
tacggccgggcgtggtggtgggtgcctataatcccagctacttgggaggctgaggcagagaactgtttgaacctgggaggcagaggttgcagtgagccgagatcatgccactgcactccagcctgggcgacagaccaagaccccatctcaaaaaaaaaaaaaaaaaaaaaaaaaatttttggggcccccgcgcctttttggggggttttttttggcccccccccttttaaaaaatttttggggggttgg

SEQ ID NO: 12633 - DNA, 502 bp, Homo sapiens
atgccattggccttatggagctcagagtctgatgtggcagacagatgatgcaaaagaaaaccaagagaaatcataattaaaggcaaagacaagccaggggtggtggtgtgcacctgtggtcccagctacttgggaggctgaggtgagaggaccactggagcccaggagtttgaaggtgctgtgcgctatgatcatgccattgcactccagcctggacaacagggcaagactttgtctctaaaaaaagaagaaagaaaaagagccaagacagatggaaaacagggtgcagtgatagaaaattcagaggcaaggatcggggagacatagagaagttaagcttcagtggtggccagacaaggcttctctgaggaatcgcatttagctgagctccaaagttgccacagaagggctgggggaggcgagtcccagcccagggcccccggcacgcaagcttggatgtttccatcactgtctggggcagtaaggatggagacaagcatct

SEQ ID NO: 12634 - DNA, 602 bp, Homo sapiens
tacggccgggcgcagtggcttatgcctgtaatcccagcactttgggaagttgaggcaggagaatggcttgaccccaggagtttgagaccactctgagcaacatagtgagacccaatctctacaaaaaataagaaaactagctgggtgttgtggcacactcctgtgatcccagctacttaggaggctgaggggggagggttgcttaagcccagggaggttgaggctgcagtgagccatgattgcaccactgcactccagcctgggctacagaatgagtccgtctccccaaaaaggatgaattggaggagagcagatgtaggtgccacctgaaggcattgaatggttgtagcaggagaacaaaggggtgaggccagaagcctgttggagtgaaggggagactctagaattcagaatagaaaggaagtcagggctgggcgcggtgactcacgcctgtagtcccagcgctttgggaggctgaggtgggcggatcacttgaagtcaggagttcgagaccagcctggccaacatggtgaaaccctgtctactaaaagtacaaaaattagccgggggtgctggcgtgcacatgtaattccagctgctcg

SEQ ID NO: 12635 - DNA, 548 bp, Homo sapiens
tacggccgggcgcggtggctcatgcctgtaatcccagtactttgggaggccagggtgggcagatcacttgaggccaggagttcaagaatcagcctggccaaaatagtgaaacccgcctcctaaaaatacaaaaattagtcaaatgcaacagagacgacaggaggttcccgtgatagaaccaaatatttgaaactaaaaaaaaacattctttctgtaaaagaaaaaaaaataacaccactccttcctgcaaaaatgttttacttaacactgggctccatctcttttttataattattcaatccaagctttgtcaaagcatcatactgagaagagattcatgttaaaaagctagtggaggggggtggagtaaatagcagagaatgcctctctgtcttatcatttttatttagattgacatacctttgattataattagggataactgttcagcagttaagactccataatcccatcattagttgtcaggagattttcacagggcaaactctcatgccatttctctcatttctggttcttaactacttggg

SEQ ID NO: 12636 - DNA, 546 bp, Homo sapiens
tttttttttttttttttttttttgtacaatatctttattaaagaaatgcattccagcaacactgtcagcatctttattaccaaagaaatacataactttaacagataatctctctgtatcttagtttttgcgctttgcaaaacaaatggagatatatcaactctcatacaattctaaaagcattgtgctgtgctgcctcacaggggtacgttcccagaggtttctctctctagagcaatccctaataggacaattgttcactctgaggcttctggcttcttatctctcctctcttggggagctgctgcttctctgtaggttgcttccctgtgacgcagggaccatagtttctgctctaataacaccttttccactctgacgtagctgagccatacactacattgccttagtcctgttcaccctttggtgattctgttccatttgccacctggcctcttcctcctcagtcacttttttcttttttttgagacagtctcgctgtcactgaggctggagtgcagtggtgcaatctcagctcactgcagt

SEQ ID NO: 12637 - DNA, 498 bp, Homo sapiens
agtgtcatgtcagcatgaccaggcctcctcggtcagattgactggttgccccctccttcctgccccaccaggtcagatggacaatcggagcaagctccggaacatcgtggagctgcgcctggcaggcctggacatcacagatgcctccctgcggctcatcatccgccacatgcccctgctctccaagctccacctcagttactgtaaccacgtcaccgaccagtctatcaacccgctcactgctgttggcaccaccacccgagactccttaaccgagatcaacctgtctggtgagtcaggggcccccatcgggtctgcctaacactccgtgggagaaccaggaggttcacatttgtggaaaacgattcgtgtgtctacagctatgtggtcacagtgctaggtgtctcgtttactgagacagacagcccagtccaggggggaaacacagtaaacaaagagttattgttggccgggtgcggtagctcacgcccgtaatcc

SEQ ID NO: 12638 - DNA, 528 bp, Homo sapiens
gtccggatgctgttgatggagtaatgaatggtgaatactaccagaaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacagggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatg

SEQ ID NO: 12639 - DNA, 579 bp, Homo sapiens
tttggcctgagatcatgctgggcccattcgggttgttaacatcgagggcgttgattccaacatgtgctgtgggacccatgtgagcaatctcagtgaccttcaggtcattaagattctgggcactgagaaggggaaaaagaacagaaccaacctgatatttctgtctgggaaccgggtgctgaagtggatggagagaagtcatggaactgaaaaagcactgactgctctgcttaagtgtggagcagaggatcatgtggaagcagtgaaaaagctccagaactccaccaagatcctgcagaagaataacctgaatctgctcagagacctggctgtgcacattgcccatagcctcaggaacagtccagactggggaggtgtggtcatattacacaggaaggagggtgattcagagttcatgaatatcattgccaatgagattgggtcagaggagaccctcctgttcttaactgtgggcgatgagaaaggtggtggactcttcttactggcagggccacctgcgtctgtggagaccctggggcccagggtggctgaggtcctggaaggcaaaggagcagggaa

SEQ ID NO: 12640 - DNA, 626 bp, Homo sapiens; identical to SEQ ID NO: 2785

SEQ ID NO: 12641 - DNA, 599 bp, Homo sapiens
ccgcagtccaagtcccggaagatcgcgatcctgggctaccggtctgtggggaaatcctcattgacgattcaatttgttgaaggccaatttgtggactcctacgatccaaccatagaaaacacttttacaaagttgatcacagtaaatggacaagaatatcatcttcaacttgtagacacagccgggcaagctgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttgggaataagaaagacctgcatatggaaagggtgatcagttatgaagaagggaaagctttggcagaatcttggaatgcagcttttttggaatcttctgctaaagaaaatcagactgctgtggatgtttttcgaaggataattttggaggcagaaaaaatggacggggcagcttcacaaggcaagtcttcatgctcggtgatgtgattctgctgcaaagcctgaggacactgggaatatattctacctgaaga

SEQ ID NO: 12642 - DNA, 641 bp, Homo sapiens; identical to SEQ ID NO: 1260

SEQ ID NO: 12643 - DNA, 469 bp, Homo sapiens
gagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagaaaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagca

SEQ ID NO: 12644 - DNA, 469 bp, Homo sapiens; identical to SEQ ID NO: 1274

SEQ ID NO: 12645 - DNA, 321 bp, Homo sapiens
acttgaggtcaggagttcgagaccagcctggccaacacggtgaaaccccatctcttctaaaaatacaaaaaataattagccaggtgtggcctcacgtgcctgtaatcccagctactcaggaggccgaggcaggagaatcacttgaatccgggaggcggaggttgcagtgagccaagatcgcaccactgcactccagcctgggcaacagagcaagattccatctcaaaaaaaaaaaaaaaaaaaaaaaaaaaattttttgggccccccccccccttttgggggctttttttttaccccccccccttaaaaaaacctttgggg

SEQ ID NO: 12646 - DNA, 630 bp, Homo sapiens
tccaaagtgcactacccatttgaaaggaagactgtagggtcagactgtctggatttgggtccagctccttcacttactaactgtgtggacccgggcacagatcagtttccttacctgtgtgagggaaaccctgtgcctcagtttccttatctctatattgaggttagtaatagtccttaccttagagaggctttttaaatattaaatgattgcgtatgtaaatgcttataatagtacccggcaaacaataagcaagcatttgcaatcatgatttgaggtaccccaacagcacaagacacactagggctaaaacgaacattcagaataaatgaccccaatggaaacagaaagaatttttttaaataagaaaactttcagaaactacaacttaatattactcaattagttttcacagaacattgaaaggatattgcaatcacaatagaagaatataaatagggccgggaccggtggctcacacctgcaatcccaggactttgggaggacgaggcaggaggatcgcttgagctcaggagttcaagaccagcctgagcaacacgatgagaccccctgtctctataaaataaattctttttaattagctggccatggtggcgcatgcctgtggtc

SEQ ID NO: 12647 - DNA, 600 bp, Homo sapiens
  misc_feature 503, 542: n = A,T,C or G
agtgtctattcttttattttactaaattaggaacgcagcatttacagaacaaataaacacaagtgacgtggccaccccaggatctaacagctcttcagtgagctatgttgcaagctcagaagtaatccactaacgaaccaagtcagactccagttcttcatcaaaaggtgctggtggaggttgtcagacgccttccaatatagatccccaatccgatggccagcaaatgagagagcagcagagatggaaggaaaactttcagaaattctgcagagaatatgccccctttcttcatgacgctcgtgttcctcatgctgagggtggccgtgcgcttcgggtgtttaaagaggaactccttggggggaatattttccggccgacttgaccaatcccatatccaatctgagtttttcttcaagatgctttcaacttctttccttctttcaatatcatcttcctcagactgtgagctgtttttctctccaatgctatgggtatctgtntcagaagctctgttggtatcttgtggtgtctgcagcgangtgggctgtcacagtgagagctcttggagctactccgtccagactcatgctgtgcgtc

SEQ ID NO: 12648 - DNA, 704 bp, Homo sapiens
acaaactgggagctgtttattggtcgccgtgagaagcctatatacaaagaaggcacaaggagggggagggaattcccctgctacagtaccatggaaggggctggggctggggagtgggcctgccaacaggcaggggtcaggagaggttttctggaactagcctcagcttctcaaatgggccttaggacacagcccatgggggagggggcagagccaggctggctctgaaagccaaggatagctaagaactccacctctaggccccctgacgcatggtcagcgtggggtctggctggatggggtggggcagggccccctgcctattctacattcaagtgtcgctccctccgtggtcttgcagggtctctctggggccttctgaggctggctggtagtggtgagtgagaagtggcatctcctctgtatcctcccaacatctgtctgtccagaattggtcccctcctctctgtggaggatcccgccgtgccccagcacagtgagcccaggctacgttgccgtttgcctgtctttgttccttcctgctgcactcccttggagttcagtctgtggccaaggagagaggcttcacagagatgcaggaaaagcaagccggtctgggtccttctttctagttcctttgctggtggtctgagcacggccggtcccttcagtgccccctagacaaccttaaggcagatccccac

SEQ ID NO: 12649 - DNA, 477 bp, Homo sapiens; identical to SEQ ID NO: 1280

SEQ ID NO: 12650 - DNA, 433 bp, Homo sapiens
tttttttttttttttttttttttggagttaattcttaccacagtcctttgacatcttattatctccattttacagataaagaaacaggcacagagggtttaagtaactttcacaaggtcacacaaccacaactagtaaagccagaattaaagtccagtcggtctgcattcaaagcctgtgctcctgccccaaagtgacaattagtgacttaaaggcaagaaaaacagacccttctctacccaccatcctcatacacagccttccagcccagaatctgaaccatttattcattttctctcatattcattcattcattcaattcttcatccacatttagtgaagctctgccgtggaatgttcacacagaaggtacaaaaatgaggcaggtgtattttctcccatctaacaggggatgaccacatgaaaagaactg

SEQ ID NO: 12651 - DNA, 506 bp, Homo sapiens
aattcaaataatttccaaatattgcattcatcacatcctcagggtaattatagcaattcaaaattatctcctgtgcacatgaacttcccagatcctgttgactcaggaactcaaatgggccatttcaatgatcatgtagaaactaatggcttttcatctttagaagagaatttacttcatcaagtggaatctcaaactgagccattcacaggacttgaccccgaggacctccttcaggagggtcttcttcctcactttgatgagtcaacattcggacaagataattcaagtcacattttagatcatgaccttgatcggcagtttacttcgcatctggtaacacggccttctgatatggctcagactcagttgcaaagtcaggctcggggttggcattcatcattttctaatcatcagcatttacatgacagaaatcacctatgtttacagcgacagcctccatcttccaagaagagcgatggttctgggacatatactaagttgca

SEQ ID NO: 12652 - DNA, 543 bp, Homo sapiens
ttttaatagtgtcaatttttgtaaaataaaaattaaacttcaaactctttactttataaattgtccgtaggccacactttaatatcacattataaagggaaggacagtcttcatttctcctggttattggtttgtttgtcattaaagatatattttgaatccgtgaaattgctatgctaaatagcctttacatgtatggtctggttaaagttcctttgttccttttgttttaataaaatgtgtcactgatttttgagctcaaaatcatcactgttaatttccagtcaccccaaatatggttaaaagattttttttttaatcatgaagagaaaattagtagcatttctttctctccccattatttcttggttttcctcactaatcttttttttttagtccaaaagccaaaaatatttatcttggttttacattttaatttccattcttaattgaaatttttttctttaaataaggaaaccaatataatctcatgtataaaaacttaaatattttacaagttacatatagcatcattctaaaata

SEQ ID NO: 12653 - DNA, 490 bp, Homo sapiens
gaagctgaagcagttcgatgcctaccccaagactttggaggacttccgggtcaagacctgcgggggcgccaccgtgaccattgtcagtggccttctcatgctgctactgttcctgtccgagctgcagtattacctcaccacggaggtgcatcctgagctctacgtggacaagtcgcggggagataaactgaagatcaacatcgatgtactttttccgcacatgccttgtgcctatctgagtattgatgccatggatgtggccggagaacagcagctggatgtggaacacaacctgttcaagcaacgactagataaaggtggcatccccgtgagctcagaggctgagcggcatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgt

SEQ ID NO: 12654 - DNA, 523 bp, Homo sapiens
gaaggtcatcgcaacgaaggttttgggaacagtaaaatggttcaatgtaaggaacggatatggtttcatcaacaggaatgacaccaaggaagatgtatttgtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgca

SEQ ID NO: 12655 - DNA, 579 bp, Homo sapiens
tacggccgggactcctcatgactcaagttgtcatagtaaaagcttttttggttaagattaaaagaaatccactatattaggcaggagactcagcttgaggacaaataaaccttgaaatctcagtggccaaatgcaaaaagcttgatttctctctcacgtgaagccccagaagggtggcacagtcctcctcagcagctctccctccactgagattggggatctgggttgtgcattcctgagttcctcactcacagccacaggatgaggggggagtgcgtgaagcacagtcactgggtgttagctgcctgggactggaagtgacacatcccatcttctcatgtcattggggagtatccagttagctgggctcactctaatgacaaagtgcgatcttcctggaagttaagcttccagaccactttagacaaaatagaatcaggaagttacagggaggtccacatgagagtcagggcaagaaatccaggcagcctcccaggaccaggaataggcactggggagaattcagattcaaggaagttcctcttgggcatcacaggtcactcttctctactttgggtg

SEQ ID NO: 12656 - DNA, 529 bp, Homo sapiens
ccataccttggcaccttcctgaaggaccttgtgatgctggatgcagcctccaaggatgagttggagaatggatacatcaattttgacaagcgggggaaggagtttgcagtcctttctgagttgcgacggctccagaatgaatgtcgtggctataacctccaacctgaccatgatatccagaggtggctacaggggctccggccactgacagaggctcagagccatcgtgtatcctgtgaggtggagccacctggttccagtgaccctcctgccccacgggtgcttcggccaacattggtcatctctcagtggacagaggttttgggctctgttggggtccctaccccgcttgtgtcctgtgaccggcccactactgggggagatgaggcgcctacaactcctgctcctctgctgactcggctggcccagcacatgaagtggccatctgtctcgtcactagactctgccttggaaagcagtccatccctgcacagtccagctgaccccagccacctctccccaccagcct

SEQ ID NO: 12657 - DNA, 620 bp, Homo sapiens
taaatagagaactccagcttggacttcttgccataatcaactgagagacgttccatgagcagggaggtgaacccagaaccagttcccccaccaaagctgtggaaaaccaagaagccctggagacccgtgcactggtcggccagcttgcgaattcggtccaacacgaggtcaatgatctccttgccaatggtgtagtgccctcgggcatagttattggcagcatcttccttgcctgtgataagttgctcagggtggaagagctggcggtaggtgccagtgcgaacttcatcaatgactgtgggttccaagtctacaaacactgcccggggcacatgcttgccagcccccgtctcactgaagaaggtgttgaaggaatcatctcctcccccaatggtcttgtcacttggcatctggccatcgggctggatgccgtgttccaggcagtagagctcccagcaggcattgccaatctggacaccagcctggccaacgtggatggagatgcactcacgcatggttgctgcttcgcgactgccgagctgatggcggagacgaagaggagaggaatactaaagttaaaacgtcacaaaggtgctgcttttacagggaagcttattctg

SEQ ID NO: 12658 - DNA, 441 bp, Homo sapiens
tgagttgactcaaagtggagatttttagacccacaatgaatgtttatacagtagactaagcattggttcctgaacattgggcactgttgagttttaaggttaattattactgagactgattccaataggactcttaccaacacagtcaccagagagtacaatcttaaatacctccttttacctatgctttttactccaacatctgtataactataattcttattttatttgcagaacactttcatgtactttaaaacagacaaattgcatgtaataatatcagctgatggttatgaagcatgtattgtatgctaggcactgtgctatgtattttacatataatatttcatttaagtatcccagccccttttgacataggtgctagtacttttccttttcatgaatgaggaggccgaaggtcacagagacaataaatggcat

SEQ ID NO: 12659 - DNA, 503 bp, Homo sapiens
ccattcttccaggagaaggaatcggcattccaagtcaaaagtcaccaatggcgttggaaagaaatgaaaaaccctggttaatcaaagatgttccagagtgcctagaactgagagggaaatggaactcatttggaactccccgtgaggaggtcgaggcgcacagggcaagcaggaagaggcgagggcacttgggggtcattatttgagatcgtaagtcttgtttcccacagacctggccgcgtcaggcagatcatcgcctggggggcctttgccaacgtggggtctcttctaacttcagcacttgacatgcggtcaccggtggcagcgcggtgtgttgaagggaaacggtagctattcattcacagttgccaagagcagctccgcgcctgctggatcgtggatgcagcgtacacatcttccttcagacgaggcattaaccccatggttaatggactggtcaccagttattattttatttttatgaatctacctttccattgatt

SEQ ID NO: 12660 - DNA, 405 bp, Homo sapiens
aagattaagaggcatacatcacttagtaaactagtgaaagcctattgtgaacgacagggattgtcaatgaggcagatcagattccgatttgacgggcaaccaatcaatgaaacagacacacctgcacagttggaaatggaggatgaagatacaattgatgtgttccaacagcagacgggaggtgtctactgaaaagggaacctgcttctttactccagaactctgttctttaaagaccaagattacattctcaattagaaaactgcaatttggttccaccacatcctgactactaccgtatagttttctctattctttcatttcccccttccccattcctttattgtacataaagtaactggtatatgtgcacaagcatattgcatttttttttttttttaacta

SEQ ID NO: 12661 - DNA, 648 bp, Homo sapiens
cgttcgtcagcttgctcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggaaccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcat

SEQ ID NO: 12662 - DNA, 478 bp, Homo sapiens; identical to SEQ ID NO: 1315

SEQ ID NO: 12663 - DNA, 328 bp, Homo sapiens
ttccactgaatgcatctaagcaagatggacctatgccaaaaccacacagtgtttcacttaatgataccgaaacaaggaaactaatggaagagtgtaaaagacttcagggagaaatgatgaagctatcagaagaaaatcggcacctgagagatgaaggtttaaggctcagaaaggtagcacattcggataaacctggatcaacctcaactgcatccttcagagataatgtcaccagtcctcttccttcacttcttgttgtaattgcagccattttcattggattctttctagggaaattcatcttgtagagtgaagcatgcagagtgct

SEQ ID NO: 12664 - DNA, 524 bp, Homo sapiens; identical to SEQ ID NO: 1319

SEQ ID NO: 12665 - DNA, 576 bp, Homo sapiens
tgattcccagtattcactcacactgaaggctctgagaagtcctattgtaatcccttttaacatcccacaattaaagtccactttcagaaatgccaaagcaggcaaatgcctctctgtgttcattcatataaaatttcagggtccccagaaccagaggcggtgttttctgcggtattacacctgcctctggaggcaagtgcagtgtctgggatttactagacaataaaagaaggtcactgaataaattttcttgaaatcattatcgttcagtatttcactatctgatagacctcaatgtcagctgcaaaggttccacttttatatattttcctttagatatcctttatagtttcttttctagataatttacaaagatgatgaacgaagctgggagcccgttcctggggcatccttgctcttgttttgcttgtctttattcctactttactgaaagctagcattctatatacagcagcacttctccccaattccatggtgaatgccaacttacgatcttattttaatatagtttcaacattattcaaaattaatacatattccccatgtatgttcccc

SEQ ID NO: 12666 - DNA, 553 bp, Homo sapiens
tacggccgggtctacatacagggtgagtgaagacacggctgtgggcaggataatagatatcaagcacggtcccagagagactgtaggccaatcttggctataaagattgaggccagggaaaactggtctgtgtcatcacatccacccaaatggccatgctactgacacctgtggttcttttaactccagggaccatgtggtgtataaatagcagcaggtatggttagtttttatagacagttgtctttccaacctcattcttaacactctactaaactctctggtgacattctcattagggagtttcctgaggataatctcttccaggagtatccttttaaaaaattagatacctaattacatttcttttttgcatttttccatactctcctcgttttccagcggaggtgtgagaatctggctaggggacagagagtagcttggcttttgcaagtaatctgtatcagagagcatgtccattcctagtataaagggaggaaataggtatagtaggaggatggttactgggacgggacaggataaggaaatgggc

SEQ ID NO: 12667 - DNA, 265 bp, Homo sapiens; identical to SEQ ID NO: 1324

SEQ ID NO: 12668 - DNA, 564 bp, Homo sapiens
ggcctgggtgaacaagagccgcacgcgcttccgcatcccttggaagcacggcctacggcaggatgcacagcaggaggatttcggaatcttccaggcctgggccgaggccactggtgcatatgttcccgggagggataagccagacctgccaacctggaagaagaatttccgctctgccctcaaccgcaaagaagggttgcgtttagcagaggaccggagcaaggaccctcacgacctacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgaaaacccactgaagcggctgttggtgccgggggaagagtgggagttcgaggtgacagccttctaccgggg

SEQ ID NO: 12669 - DNA, 525 bp, Homo sapiens
tttttttttttttttttttttttttcctacaataaggtgtaatttataaattaggcctagtaacagattgacaacaacagttaacaataaaatagaacaattataacaatatagtgtaataaaaattgtgtggatgtggtccctccccctctctctctctcactctaaaaatatcttactgtactgtacccactatttttggacctcggctgaccatgggtaactgaaaccttggaaagggaagccatgcatggggtgggtggcgggggactactgtaattagctttttcaagagcttgctccaagccaggccctgtgctgagtgccctgcatgagttacccatgtaatcttccactggccctatgagtggatggatacctgtcagatctccacttttaagatgaagaaactaaggtccggagtagttcattcactttcttcagcaaggtcacacagaagtggtaacatgtacttgcctgaccccacggttttcagcatgcagaattcaggtttgggggaaatgg

SEQ ID NO: 12670 - DNA, 606 bp, Homo sapiens
ctttctttgcggaatcaccatggcggctgggaccctgtacacgtatcctgaaaactggagggccttcaaggctctcatcgctgctcagtacagcggggctcaagtccgcgtgctctccgcaccaccccacttccattttggccaaaccaaccgcacccctgaatttctccgcaaatttcctgccggcaaggtcccagcatttgagggtgatgatggattctgtgtgtttgagagcaacgccattgcctactatgtgagcaatgaggagctgcggggaagtactccagaggcagcagcccaggtggtgcagtgggtgagctttgctgattccgatatagtgcccccagccagtacctgggtgttccccaccttgggcatcatgcaccacaacaaacaggccactgagaatgcaaaggaggaagtgaggcgaattctggggctgctggatgcttacttgaagacgaagacttttctggtgggcgaacgagtgacattggctgacatcacagttgtctgcaccctgttgtggctctataagcaggttctggagccttctttccgccaggcctttcccaataccaaccgctggttcctcacctgcattaa

SEQ ID NO: 12671 - DNA, 633 bp, Homo sapiens
gagcccaactcactccagtgggtcggctcaccgtgtggcttgcacggaccttacattttctacaaggcttttcaattccaccttgaaggcaaaccaagaattttgtcccttggcgactttttctttgtaagatgtacgccaaaggatccgatttgcatagcggagctccagctgttgtgggaagagaggaccggccggcaacttttatccagctctaaactttatttcctcccagaagacactccccagggcagaaatagcgaccatggcgaggatgaagtcattgctgcttccgaaaaggtgattgtgaagcttgaagacctggtcaagtgggtacattctgatttctccaagtggagatgtggcttccacgctggaccagtgaaaattgaggccttgggaaggaatggacagaaggaagctctgctgaagtacaggcagtcaaccctaaacagtggactcaacttcaaagacgttctcaaggagaaggcagacctgggggaggacgaggaagaaacgaacgtgatagttctcagctacccccagtactgccggtaccgctcgatgctgaaacgcatccaggataagccatcttccattctaacggaccagtttgcattggccctggggggc

SEQ ID NO: 12672 - DNA, 587 bp, Homo sapiens
atttacagagtgaggagcagatgtggaatgtggactctatagataaagaccaagaggaaggttgtttcccagggcaaaggaacacagagagtaagggagtctggccttgaaagcagggaacaaaggacaaggaaagttcaacaagttaaccctttgaagaagaatgtcttactgtatttaacaggccatgatgttgccttctgtggcacctacaggcaggtgccccatgtttggggctgggggcagagtgactgccgagaaacatgctgtggaggatagcaccatggacatctctgggcttaggggaatgttctctctcctgattatgacatccatctatacacacatcaaaacacataaagctacacaaccaaagagccaattttactatatggtaatttaaaaaataaaagtatacagttatagtcctaaaatttaagagggaaagcccggcgtggtggctcatgcctgtgatcccagcactttgggaagccgaggcaagtggatcatgagatcagcagtttgagaccagcctgaccacacggtgaaaccccgtctcttctaaaaatacaaaaattagccgggca

SEQ ID NO: 12673 - DNA, 379 bp, Homo sapiens
tcaaggctgcagttagctatgatggcgccattgcataccagcttcagtgacagagcctgaccctgtctcaataaataaataaataacactgattttttatttgtctgagccactgcaaatgagaaatcagacatttaataaatcatgtattgatgggcatttaaagtgtttctaaaatacttcgttgtaaaaatcttactgagcctgtaatcccagcactttgagagaggccaatgtatgctgggcgcggtggctggcaagaggattgcttgagcccaagactttgagataaataaactgggcaacatagcgacataaacctctacaccaaaattttattttattttattttatttatttatttttgagactccatctc

SEQ ID NO: 12674 - DNA, 460 bp, Homo sapiens
ttggaattgggtttttacatcacatattgtttgattataaaaaagcaacaacacagccgggcgtggtggctcacgcctgtaatcccagcactttgggaggccgaggcaggcggatcacctgaggtcaggagtttgagaccagcctgaccaacatggtgaaaccccgtctgtactaaaaatacaaaaattagctggacgtggtggcgggcgcctgtaatccaagctactcgggaggctgaggcaggagaattgcttgaacccaggaggtggaggttgcagtgagccaagattgtgccattgcactccagcctgggcaacaggagtgaaattctttctcaaaacaacaaccacagcactatgcttgtgttggggcagaggataatgaaaaatctctgtacctcccactcaagtttgctgtgaaccttaaactgctctaaaaaaataaaacgtatcgaaacga

SEQ ID NO: 12675 - DNA, 571 bp, Homo sapiens
ttttttttttttttttttttttttgatgtttacaatttaataaatctcttcattgcagacatgtatggctgtttggtagtattcagaaacatcacagtaatggcagtttcttcaattggtgtgtagtcctcaataattatatatgaaattgctgtcaaaccagtaagactgcatttatacatccatcagtttcaggactgttggtaacctgggcatattttccccaaataactttgcctccttgtgtcacaaggcccaattcgctcacatttacttcaatgacagtacctttggtaataacacccaaagttgtatacagtggggatgagggattcttctttacaccaagtattggtaggcaaaaggtggctttcagttcaggatgtgttacatgggctttcttgaaacgcaagcccattggcctgatgaatctttcatatttaggtggttttcttgtaaagccatctccaacaaagcacactttagtaaccattctcttccatgccttcttctttctctttcctgttcgaataacttttaatacttctgtttctccctgggcacgtacttt

SEQ ID NO: 12676 - DNA, 512 bp, Homo sapiens
tttttttttttttttttttttttttcgaaatacataaaaacattttattcacaaaattggtcatcacagcattatttacaatactgaaaatctggaaatagcctaaatttctaacaattgaaagaaggttaagtaaattataagactacacaataaaatatattaccagcaatatatctttgtgaaaatctataataaccacacataatacttagtaaaaaagaacataaattacatgataaagaatatgatcagaacaatgcaaaaaattcacacccccaaaaaagacaagatattatatggcaattttgtggtaaaatattcatgtatttgtgcagcatttctattttttccgtaactgacacatcagttttataattaggaagaaaatacctttttaaagtaaagcgaacacaagattctttagcaatgttcattccatcccacaatagagtctagagagtcacaaaaacctcagcctccttcgggaggaggggagcttggttgtgaaa

SEQ ID NO: 12677 - DNA, 358 bp, Homo sapiens; identical to SEQ ID NO: 1371

SEQ ID NO: 12678 - DNA, 510 bp, Homo sapiens
atataagaaagatgggataacctggtacacaaatgttgcccagtatgtgcgcattgccagtggacttcattttgtaaaaatggaatagaggcagtaccccaccatgtgtactgttgagccggctgttgagaaacaacttggttcagccggtggttttgcttctcctttgtgttcctgtgagtaggctgtgccgatggcagcagcgccacgtggtatctgtgcgctggcgatgagaggagcgctttccatttggaggcagtgtgagcacacgctggagtgcagcgttccaaagtccgcccgaaatggatgctgcgtccacggccatcacctgtgcgggaacacctggtttccttaagacaatttcctttttgtccttttatatttttctaaagaaaactaagatataaactaccaagtgctcttaagaataaaaataagaataagaatacaaaggagcactactcttggctacacgaaagatcttgggattcatgacactgagggcaggga

SEQ ID NO: 12679 - DNA, 542 bp, Homo sapiens
tttttttttttttttttttttggatttttggtagagacaacatggggtttcacaatgttgcccaggctggtcttgaactcctgagctcaagtgatctgtgtgctttggcatcccaaagtgctgggattacaggtaatgagccaccgcgcctggccaaaaccatgtttttaaatgaaattttcctcccttatcttttgtattaccttggagtatcttgcattaacttgggatacttgtaatatcatttgtattaaccttgtgcaggatgtggctctttgcttgtggcagcccaatgggaagagtaagaagactccttgttgtggctcacaggctcctacatggccacctctctgacatcatctcctgtttttcttgccttctacttgctcttcttgctccgaggaacgtcgtcttctagatcttaatggctgtttcttcatgcgtaaggttttagctcagatggccttacttggtcatcctatccataataattcctttttctgataggaacattttcacctgcaagtaaatagaaaacttga

SEQ ID NO: 12680 - DNA, 513 bp, Homo sapiens
tttttttttttttttttttttttttggagttggttaaggttgaggcctgctttttgctttatttctgaatggtcattaattctttaggtcacctgccgatggtgaaggtgcctgaggtgcctggtgttactcagcactgctctgctgggtgggtggagcagggttctcagttggtgcttcacctgccttggcctctttgccatcttgtgaaggagcgttaggaggacgcgggcgacgccggtaattgtagggacgccggtatccacggcgaacagacggctggtttggaccactggtggcttgctgattttctttatcttcagcctctccaactgctggggcaggtcgtgggcgaggaggtcccctgctacggtaccttgggcggtaagttggatttcgatgaaccggtccctgaagttgtgctccctctgggactccatccttcatctctccaatctcaccagcctggagaggcaatgagagctgacagtgagtgtcacagcacaggggata

SEQ ID NO: 12681 - DNA, 565 bp, Homo sapiens
tttttttttttttttttttgggatatgacctttattgaacttatccaccagagtggaaataatgtctgtacaaaaccaaatgtttgttactataacttctgcatcacaattaaaatccaaacagttttttaaaaacagtcaactcaatcaaaacccactacttcagaatcaatagcttctttgaagccacagtaacacttaaatatggttaagactcgaatgcagaaatttggttggttggaaagctaattaaacttccaacttgctcaaatagaattacaaaaaggcaaaattgtgtttttcacagagatacagtccactggaatcaccaacactggacggctgttagagtatttagagtcctgagataacaaggaatccaggcatcctttagacagtcttctgttgtcctttcttcccaatcagagatttgtggatgtgtggaatgacaccaccaccagcaattgtagccttgatgagagaatccaattcttcatctccacgaatagcaagttgcaagtgacgaggggtaatacgctttacctttaagtctttcgatgcattt

SEQ ID NO: 12682 - DNA, 458 bp, Homo sapiens
tttttttttttttttttttttttcttaaataatgaaaatcaaactatgataaaagttaggaaacgtgcagaaccaccaggaaaacagcaatttgctttcagcgtacctttgcaaggatgttccaaagcctcatgtacgagtgagatttctgggccacttgcacaagtagataaaccctcttctcaggccagttataaagggctgagatgagccacagaagcccaagatctgctctgattgtctcctagctattttctttcctcttttttttttgagacagggtttcactctgtcacccaggctggagtatagagtacagtggcaatcatagctcactgcaagcttcaacctcccaggctcagatgatcctcccaactcagcctcctgggtagctgggaccccagccatgtgccactgcatctggctaattttttaatcttttgtacacatggggtttt

SEQ ID NO: 12683 - DNA, 336 bp, Homo sapiens
tggtggcaggtgcctttagttccagctactcgggaggctgagacaggagaatcgcttgaacccgggaggcagaggttgctgtgagccgagaccatgccactgcactccagcctgggtgacaagagcaaaacttcttctcaaaaaaaaaaaaaaaataagccgggaaatcaggggactttgggtcccaaaccttttggggggcctttggccaaatccccaccggggtccttggtttttccctttcccaaaaaaaaatgttcccggggttgggaaaaccattccggggaaattcctttgcgggaaaaaattttccccccattttttcccattttgacc

SEQ ID NO: 12684 - DNA, 628 bp, Homo sapiens
ccaggggccttcgaggtgccttaggccgcttgccttgctctcagaatcgctgccgccatggctagtcagtctcaggggattcagcagctgctgcaggccgagaagcgggcagccgagaaggtgtccgaggcccgcaaaagaaagaaccggaggctgaagcaggccaaagaagaagctcaggctgaaattgaacagtaccgcctgcagagggagaaagaattcaaggccaaggaagctgcggcattgggatcccgtggcagttgcagcactgaagtggagaaggagacccaggagaagatgaccatcctccagacatacttccggcagaacagggatgaagtcttggacaacctcttggcttttgtctgtgacattcggccagaaatccatgaaaactaccgcataaatggatagaagagagaagcacctgtgctgtggagtggcattttagatgccctcacgaatatgaggcttagcacagctctagttacattcttatgatatggcattaaattatttccatatattatataataggtccttccactttttggagagtagcaaatctagcttttttgtacagacttagaaattatctaaagatttcatctttttacctcatatttct

SEQ ID NO: 12685 - DNA, 643 bp, Homo sapiens
tacggccgggaacccatgtcttgctgatataatcggtcttatctctccagccagacgtgggttcccgtcctgaaagggccatccctcttgtccctctgtccttccagtgctttgacatttggtgggcacagagtagaacaatacaaagtactgaacaataactttggttttcttgccaattttattgcttggcaataaaattgtatacctaaggaaagaacgattttaattttttaactttagaactcaacaagcacttgtttggtattgatactttactttgtaagccttccacaagaaatcaaataatgtctcttgcgctgaaatcgtcaacgggttacacactctgcaaagttatgggaagcacagccctgaccttaataaatgccaaattgggtggtaatttaaaaggaaaaaaaatcttcacgtaagggttggtggaaattattatgcttccctctgcccccgccccccgccaataacagagtaattgaaccaggaactgagagtgtttagtaatttaatgaacattggtttactaaataaccagtttatatgtttgataatatagcacattttattattgaaaacatttcaaattagactttgactttcacttgttttattatggagaaaaggattt

SEQ ID NO: 12686 - DNA, 530 bp, Homo sapiens
tgtgctgggaacatgtaccactgagcctgagatggggatgagggcagagagaggggagccccctcttccactcagttgttcctactcagactgttgcactctaaacctagggaggttgaatattgttacccttaggttttaacactaatcctgacaccaccatctatagggtcccaacttggttattgtaggcaaccttccctctctccttggtgaagaacatcccaagccagaaagaagttaactacagtgttttcctttgcaccgatccccaccccaattcaatcccggaagggacttacttaggaaacccttctttactagatatcctggccccctgggcttgtgaacacctcctagccacatcactacagtacagtgagtgaccccagcctcctgcctaccccaagatgcccctccccaccctgaccgtgctaactgtgtgtacatatatattctacatatatgtatattaaaactgcactgccatgtctgccctttttgtggtgtctagcattaacttattgtct

SEQ ID NO: 12687 - DNA, 386 bp, Homo sapiens
aagccagctctgtgcctggaggggactcgccgccatctcaggtctcttggctttgccagggcccaccggagaaaactgacgacccgtttctgtaatccttatgggagaccaaccttgtgcctccgggagatccactctcccacctggaaacgcacgggaagccaagcctccaaaaaagcgctgcctcctcgctccgcgttgggattatccggaaggaactcccaacggaggtagtaccactctaccctccgcacctcctcctgcataagccggcctgaagtcgcaccctcctcctccggagaagtagggaaataaatttctcccaccctaaaccagtctttgagtgattgcagtatgactccatttccctggggcattcatataat

SEQ ID NO: 12688 - DNA, 551 bp, Homo sapiens
atagtaagatgtgaggccatctttgaaaaatgtcagctgtgtctagccccagggcattgggcgttccaaaagaaggaatacatttctttaaatgtatcattatttcggttcttagttttttctcaggagtttatgtctgtcttgtttctcctaccattctcattcattcattaattcagtcagtcattccctgagtacctaccattctgccaagtgccaggtatctctagaaatcataagataaatgttttcccttcagggagcacactgtgtagagtagtgatgaataagcagtccaatataaagtgacaaaaattattaatagaagcctggaggaagaaggatctaaccaacaggtagctggtggaagcaggtgaaggagaacactcttagaatgagttctacaggtctggaggaggcttatgggtgaacaaatggacaaaggtgtcaagtagaagaagggcagcgaggaagagggaacacaatgtgcaaggtcatggagctattaaagaactaaaagcctttttaataaataagtattttcttgaaaa

SEQ ID NO: 12689 - DNA, 354 bp, Homo sapiens
gtgataaataattactaccgttattaagcaattgcagtttgcagtgtgccaggcactgtgccaagtattttgcttcgatgacttcacgtcatcttcaaaacaacctcatgagggctgggtcagttagaacctaaacaaactagagacctggttgcaacccctcaggctctgctgatgctgtccccctttgttcctgcagcgtggaccctgccagcagccaggccatggagctctctgatgtcaccctcattgagggtgtgggtaatgaggtgacggtggtggcaggtgtggtggtgctgattctagccttggtcctagcttggctccctacctacgtagcagacagcggtagca

SEQ ID NO: 12690 - DNA, 652 bp, Homo sapiens
ccggggggggagctgcgtagctcccggccccgcggccatgcccaagcggagctgccccttcgcggacgtggccccgctacagctcaaggtccgcgtgagccagagggagttgagccgcggcgtgtgcgccgagcgctactcgcaggaggtcttcgagaagaccaagcgactcctgttcctcggggcccaggcctacctggaccacgtgtgggatgaaggctgtgccgtcgttcacctgccggagtccccaaagcctggccctacaggggccccgagggctgcacgtgggcagatgctgattggaccagacggccgcctaatcaggagccttgggcaggcctccgaagctgacccatctggggtagcgtccattgcctgttcctcatgcgtgcgagccgtggatgggaaggcggtctgcggtcagtgtgagcgagccctgtgcgggcagtgtgtgcgcacctgctggggctgcggctccgtggcctgtaccctgtgtggcctcgtggactgcagtgacatgtacgagaaagtgctgtgcaccagctgtgccatgttcgagacctgaggctggctcaagccggctgccttcaccgggagccacgccgtgcatggcagccttccctggacgagcgctcggtgttcacactgaact

SEQ ID NO: 12691 - DNA, 565 bp, Homo sapiens
attaaaggatgcttataatttggtaggaaacagccacatagaaactgagtttttagttagttagatacagtacctaaaggaagcactggttacacagagcaggaccaggtatttccttacagtcggcagctcggttctttagtaagaacctgtcccttttatacaggtgctagtgtcatatttcagcagcatgtatgctaacatgcaaagttgtttctgttcaagaaaatgctcacaaacattgagaggcagtgtgtagtggttaagaaaatggactggggccaacttgcttgaagttgagtctgggctgtatgacttattaactcagttactttgggcaagttacttaatctctctgtgtttcaatttccttatctaagaaatagggaatattataccctagacttcatagatatttgtgagcatttgatgagttcatgtatataaactttctagaatcggccaggtgtggtggctcatgcctgtaatcccggcactttgggaggcccgggcaggaggatcccttgaactcaagagtttgagaccaacgtgggtaacatgatga

SEQ ID NO: 12692 - DNA, 561 bp, Homo sapiens; identical to SEQ ID NO: 1394

SEQ ID NO: 12693 - DNA, 497 bp, Homo sapiens
tacggccgggcgtggtggcatgcggctgtgatcccagctacaagggaagccgaggcaggagaatcgtctgaacccgggaggcgcagtttgcagtaagccgacatcgcaccactgcactccagcctgggcgacagagcaagactctgtctcaaaaaaaaaaaaaaaaaaaaaaaaaaaaaaaaaaaaatttttttggggccccaaaatttcaaactttttttttaaaaatgaaaaaattcccaaattgaaaaatttttttttggccttttgtttttcctttccccattttttaaggaaaaaaaaaaaattttggttttccaaaaatttttttttgaaaaaaaataactttttttttttgggaaaaaaatttttccttttttaaaaaaaaccttccttttggcttttttaaggggtaaatttgcttttaaaacccaaaagaggttttttttttttaaaaattccctttttaaaacaatttttttaaaaaaaaaaaaggg

SEQ ID NO: 12694 - DNA, 534 bp, Homo sapiens
gtggtgcttgcctgtaatcccagttacttgggaggctgaggtaggcgaatcacttgaacccaggagatagaggttgcagtgagccgagatctcaccactggactccagcctggcgacagagtgagacttcatctcaaaaaaaaaaaaattttttttttttttttttttttgggtttcccagggggggggcttttttatattctttttttttttttttttttttccggacatttttttaccctttggggatttcttaaaccggggttttttttgggttttttttggtctttcaaaagagggccctttgggaaaattttggggcccttttttttttttgggtggatttgccctgcccttgtctttttgggatataccctttttaggggttttttgggctcccctttcaaaaaaactgttttaaaagatggtctcattttttttttttggacagggaaattaatttttttcccccagaaaaaaagcccttttattttttaatttccccccttatttaagggggggtgtttttttttt

SEQ ID NO: 12695 - DNA, 329 bp, Homo sapiens
tttaaatgctgggaatctatagtttgttccatgggagaccttttaaataatacagaagttttaaacagcaaaatttacttgacactgcaaattttaaaaactagtttatatccttttactaaatatttcccaatggaaacagcgttcacatttcacaagtttcacttgattactttcagattttgtatgagtataaagtgcattagttttacaaattatacaaaaaaaaactacccagggtacccatcttgctgattaaacttttttgaatttttatttatttatgtttataatatcaacttttattttagatttggggggtacatgtg

SEQ ID NO: 12696 - DNA, 550 bp, Homo sapiens
tgcatatgaagctgtcgctccttccgggccagctcgtagtatttcgcttgctcttctctggacagtgcatgccctaccctgcgcccttaggacccggactgaccgtgtacaaaactttacgtgccaaaattctcagtgaatttagctttctccctctttttgatgctgtaatttttgttcatcatgttttgctgtgatgttacataggtagatttgtatgtagttttaatgtcacctataacaaaatgtgtttggtagcagattgtccagaaagcattttaaatgaagaggtataaacccttaagggccaaaattctgtatattagattactcttaaacgaaaaaccagctgccgcttttatgtacacatattacatacgagtaggcagcagactttaaaaataaaaaaaacctaggcatgttgatgttgcaaaatgctgtataaagctgaaacctgttcattcagtgccattgtagttgacatgaagcgattgtaaaactgtctccgatttttctctggtttattaaaatgctaactataacatttttt

SEQ ID NO: 12697 - DNA, 417 bp, Homo sapiens
ttttggcctgttagcaactttttatacctaacattgtttgagctaagtaggaatcaaatctgacaaccagagagaaatgcttattttctacatattaaaattgattctttttcattctggagatggaaaagaaaagccctatatctaatttaatcaatgagaccttattagaaaatgggagatccaagattgcacaaagttcaaattaaagcaggcaactctgacatctagcaaaatatacgaatctcctcttgactctcgaaaacaaatcacattcctaaccaaaggctaaagtttggggtatttagggagctagggagtcctagagagagaattggacaggtctgaggagaaaaaggataatttaaatataaaaaagtggaaaaaatcggttttaagtcatagcatgtctttgag

SEQ ID NO: 12698 - DNA, 334 bp, Homo sapiens
  misc_feature 281: n = A,T,C or G
tacggccgggcatcaaaatctaactgccccatcctggagacattttgcagggctttcctttcaagtctttcaagtacaggatattaccacaacagcagctgaactgttgtaaccagcatgtttttcctatttccactgtgacctgcagctgactcaaagccttgcgtgacctgacccaggtgcaagagacaggggaagagggatagagggtatagcataaattacatattttcatggctttgggtggttcctccaaaaataattggacctgtaaaaactantgtgtgtgtgtgtgtgtgtgtgtgtgtgtgtgtgtggggttttttttttaaat

SEQ ID NO: 12699 - DNA, 583 bp, Homo sapiens
tacggccggctaattttttgtattttcaatagagactggctttcaccgtgttggccaggatgatcttgatctcctgacctcgtgatctgcccgcctcggcctcccaaagtgctgggattgcaggcgtaagccaccgcgcccagcctaacttttgtaaatagttttataagtagggtatttattttgtagattattgatatatgtagtccaatatgcaaacgatacagaggtatatctgatgaaaaactcgtctcccactgacatgcctcagacaacacccctcctggtggcaagtccattagccagtttttgggtgtccttgcagagatctgcgtggcatatgagaatagctatgcatgcatgtatcacataacatgtatatgcatttgaacaccatggtagtgtgtgcaaaccgctgttctacctctagtgttttttctttgtgttagaggtaattcagcatcagcacacattacacagcattgtcccatttctctataatcccatgctttccaagtgttaccttacgtctgtagtttacttgttagtcctccgcttgtgagtatgtagcatatgtaacagt

SEQ ID NO: 12700 - DNA, 646 bp, Homo sapiens
tattgcactgggtcacaaaatgcagtattagctcactgccatccttcccgaacatgctggctgccatctacaacacaacagagctggtgatgatgcaggactcctctccagactttgaggacacttggcgcttcctggaaaaccgggttaatgatgcaatgaacatgggccacaccgccaagcaggtaaagtccacaggagaggcactggtgcaaggactcatgggtgtagcagtgacgctcaagagcttgacaggtctaaaccagcgtcggtgagaggaaggggtataagctacaatgcctagaagagaatgagcggacagattgaaagagctttgaaaagtataaggtgccatccacataacctggtgttcacgagaacacactaaaggactcctgagtcactaccacagccacctggaaaccacaaggcatttgatgctaccgttctggtcagggattgggctgcttcttcagttcctaataccagaccaagcctcctgatgcctttctgcactgcaactgtgtgattgaaaaatgagatgttcatccaagcagtcaagccacagaaacccagcatgtccctgtcacgatctcatgggcaccttgatcatgtcttaaccttcccttaaaccttgggctcccag

SEQ ID NO: 12701 - DNA, 518 bp, Homo sapiens
tttttttttttttttttttccagtttggtattaactttattctattttctgtataactttaagtacataaaggtttatttccacaggcctcaggaaatgggtagaaatcacaggacaatctctcttcccaccaaaaaaaagttgtatattttggtaagtgtttgtcctagagggaaaaacaactgaaatttacattagcagtgctgtgcaagattcttacataattcaagacctaaaaccagcctgcagtggaggtttcagtcctctgttcaggtgcttagacagaagccataagctgatgagcatgacagggaaaaggaggcagtgaagacaggtgacaggcacctggcagggaagaaggattcaggaatgccagactccttgaaatcatgtgggtttgtttttttttttttttcttttaaagtcatctctataggaaggtgctgggcagggatcccagagaaagaaagggtccaagactccattaactgccctggatgaagggcactgctacagca

SEQ ID NO: 12702 - DNA, 507 bp, Homo sapiens
ttttttttttttttttttttttttttagagagggcagttttattgtctcagaagggcagggctgagggagggagctgaggagcaacatccccccaggccccaaggacacacacactctgtccttcccatgggccatggctctgggagcgacccacagaagggagaggaggctcaaactgcccccaggccccagggttctcaggtcagggagttagggaggaacatgaaagtgacacgcttcttagatacatcagcggctgtaaccacagggctgagggggcctccttgctctggagggggtcttcgtccatccttggtggggggggtgcccagccccttttcaggcctaacaacagtctctaagagggtcaggagaactgggcagccgctaggacagcgtactacaccccggacaggcaggtgagccacaggcttgtcacagaccacatacacacacacgcacacacacgcgcacacacacacacacacacacaaagagtgcaattg

SEQ ID NO: 12703 - DNA, 597 bp, Homo sapiens
tttttttttttttttttttttttttaggtaagctttcacaatttttattaaatcctagtctagttgagcaatatctgatgttacagacatcatcccatggtgaacatgtttaataagtgaaagcaagtcagacatctcatctaagtcattattttctgcagactaagcaataactacacagaacactatgggtaaacaaacacctgctcagttttcacacaagccatgttgtttatcaaattagatctgctaatattgaatacagtagattcggtgattgtagttctcatataagtatcttattgagataacattttgacagtttcactgactttccaaataagcacaccataatcaaagaaaagaataaagagtgaagtaaaaactgaacatgaagagattaagttattaaaggaaaatgaagtaaataaaaagagtgaaaaaccattgggggtggaagtcaaacaagcctagacatttgattggaagagaaaagatcaaatatgaagttcacaaatcaaaagtttataaactcaatgcaatactaatcctttttattgtaaaagctgagttgaaactaaaagatctataaaaact

SEQ ID NO: 12704 - DNA, 568 bp, Homo sapiens
ttttttttttttttttttttttttcagggaaggaaaatatcagacatagctttattgctgactcctgcccccttcagagcccatagtcacaggcctcagggctgttctgtaagtagagctctaggaaaccttgccagtctttctcactagtaagcagggctgagactgtgggatcttccttcatggctgccatccacagtttcagttttggagtgtggtctacacactcatttaacttcattgcttccagccgttcaaaccagggccagatgaggtaatcaatcatagagatagaattgccaccaaagaaggtcgtcttcttattagtcagaacctcctctagcttggtaaattctttacgaaattcttcttttaggccagcatagtcttctttattttggcttctaataaagcttcctaccaaggatggcaccttagaaaacaactctaagatcatcttctggcaagctttctcataggggtcatccggcaacagcttcttccctgggtatgcttcatccaggtactcacaggtgatggcagactcgtagatcagctgaccctgact

SEQ ID NO: 12705 - DNA, 609 bp, Homo sapiens
caactggtattaagtgttaataatggactatgtagaaattttatctacatttaaatcctaggatctacacctcataaagttattgaattattacccccactttacagatggaaaactgaatattaatggcagcgattcaaatctacacaatctagatgaaaagttctagaacaacattgccactgactgattaaaaagtcaactgaaggaaaagccagtgagaaacaaggcaatcaattactgtacagtatttagctttggatatgttaattctgagatccctattagacctccaagatattaaaagggagaaatttgggagagatatggggactggagatacaaatgggagagtcaggtacttaaagccactggacttaacagaggagaatacacagggagtggctactaataaagacgttgtaggactgactgagccctgggagccttccaacatttagaggtagggacgacaaggaagaatgggggttgaggggaatagccagtgaaggaaaagagacaagaaaatagtatgaagaaaactaatgggtccaggcacagtgactggccaacatggcgaaaccccgtctctactaaaaatacaaaatt

SEQ ID NO: 12706 - DNA, 622 bp, Homo sapiens
agggctcagatcttcgcaaatactgtggacaatgcccgcatcgttcagcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccgggcccaatatgacgagctggctcggaagaaccgagaggagctagacaagtactggtctcagcagattgaggagagcaccacagtggtcaccacacagtctgctgaggttggggctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgc

SEQ ID NO: 12707 - DNA, 397 bp, Homo sapiens
atttagaagtggtaggttgaataactgatatttctagctttgtcattagtttattatgaggatcattttggaaagtcttttgatctttgcctctacaataaattagtaacaaaattatctgtattatgaggatttgtgttgttgttgtttctttatttttgtttgaaataattgttttctatatttcttttgctgcaggaaaagttttgggtttattgtgttttctcataactgtataattttattttattttaatttacttgtgtgtctgtgcatggagatgagggccttgctttgttgcccaggctggtctcgaattcatggcttcaagcaatcctcccaccttggcctcccaaagtgctgggattacagacatgagccaacataactgtataat

SEQ ID NO: 12708 - DNA, 589 bp, Homo sapiens
agcttccagcaagtacaagctcagggactctgtctacatcttccgggaaggggccttgccaccctatcggcagatgttctaccagttatgcgacttgaatgtggaagagttgcagaagatcattcaccgcaatgacggggcagagaattcctgcacagaacgggatgggtggtgcctccccaagaccagcgacgagctcagggacaccatgtccctcatgatccggcagaccatccgctccaagaggcctgctctcttttccagctcagccaaggctgatggcggaaaagagcagctgacgtacgagtctggggaagacgaggaggatgaggaggaggaggaagaggaggaggaggacttcaagccatccgacggcagtgaaagcgaaatggagacagagattctggactacgtgtgacagggcccaaggctgggcctccctgacccggccagactggtgtctggcctaatgagggagccggggctccccattgccacccacagtgcccggaatggccctaggaggccctctgaggagagctagagtcccagcaaagggtgcagctgaccctagcactggctgtgacat

SEQ ID NO: 12709 - DNA, 173 bp, Homo sapiens
cctgtagtcccagctactcgggagactgaggcaggagaacccaggagacagaggttgcagtgaactaaaatcgcgccattgcactccagcctgggcaacaagagcaaaactccatctcaaaaaaaaaaaaaaaaaggggggggggggaaggccccccttttaaaagggcccgg

SEQ ID NO: 12710 - DNA, 570 bp, Homo sapiens
taaagaaattttcctaaaggaccccatcatttaaaaaatggacctgataatatgaagcatcttccttgtaattgtctctgacctttttatctgagaccggaattcaggataggagtctagatatttacctgatactaatcaggaaatatatgatatccgtatttaaaatgtagttagttatatttaatgacctcattcctaagttcctttttcgttaatgtagctttcatttctgttattgctgtttgaataatatgattaaatagaaggtttgtgccagtagacattatgttactaaatcagcactttaaaatctttggttctctaattcatatgaatttgctgtttgctctaatttctttgggctcttctaatttgagtggagtacaattttgttgtgaaacagtccagtgaaactgtgcagggaaatgaaggtagaattttgggaggtaataatgatgtgaaacataaagatttaataattactgtccaacacagtggagcagcttgtccacaaatatagtaattactatttattgctctaaggaagattaaaaaaagatagggaaa

SEQ ID NO: 12711 - DNA, 423 bp, Homo sapiens
ttttttttttttttttttttttttttgggtgggtttgtttttgtactgctgaggaaagaagtaccagcagaagctgcagttctaggttggggaagtctggggaatcctgcaagggaacatccttcgggaagggggacagaagtggagaaggaacgactgaaaggatgctaactaggttattattagcaggaagttagggcattttcttttctggagaggctctccagtcccagcttggaggtgtgcaatgcctcagcctgggaagtatctgcagtgttcgaacaaatgagagaaaggaaggagcagtgccaagaggtacttaaggagaaagaattgtattagtgtggagccaacctttcccgggcagccaccctgcccttacacttacacacacacactttgcttcacttggcatgcaataag

SEQ ID NO: 12712 - DNA, 536 bp, Homo sapiens
tttttttttttttttttttttttcttccataaacacaaactttattgaggccctcagcactagttctctttctcctgcacagtcttggttccccggagacgtccagtccggcgggcagcaatgagacccactttgcggccagcaggggcatctctgcggatggtggagggcttgccgatgtgctggtggttgccacctccaaaaggatgctccacaggattcatggccacaccccgtactcgtggccagcagttcctctttgccttatatttgtggtacgcccggccagccttcaagatgggtttgtcaattcggccgcctccagccaccacaccaaccacagctctgttggctgaggagataaccttcttggagccggagggcagcttcacacgggtcttcttggtctcagggttgtgggagataacggtggcatagttccctgatgcccggaccagcttgccacggtctccaggcttctcctccaggcagcacacgattgtaccctcaggcatggtgcccacagggagcacatt

SEQ ID NO: 12713 - DNA, 633 bp, Homo sapiens
ttttttttttttttttttttttttttctgaaagactaaacagatatatattttatttcatctgctaaatgtctgagagcaagttagacacacattccactaagcatcaaaggccctcgtagtctcggtggaaggacaaactccagctccacatcactggtttaagtttcttcctcttcttcttcctcttcttcctcctcctcttcctcctcatcctcaacagagctgaaggtgccatcagggaggctgtagacacggatgacctgcttgttggggtccttgaggatgaggtatttgccctcctccagcttcatgcagatgtcaatgacgcagcgtaaaatgccccaggcattctccacgctcaggttgatctggctggcaaactcattaggcttgaactgctgggtgcctaggatgacgtggcgtgaggagtctttcacgtggtaccgagacacataaccaagcttgaggtactcagatccagccagcaaagcacagcaggtccaccgggccaacttgtagctgttgttcttcagctccgtggcaatgacagcccctcgctgagagtccagcttctgacgccagtcaacgccattacagtgcctggaatcccactcattgagtgtcttgatgt

SEQ ID NO: 12714 - DNA, 514 bp, Homo sapiens
agatcttacgccatgatcctcacaagctgctggaaggctgcttggtggggggccgggccatgggcgcccgcgctgcctatatctacacccgaggggaattctacaatgaggcctccaatctgcaggtggccatccgagaggcctatgaggcaggtctgattggcaagaatgcttgtggctctggttatgattttgacgtgtttgtggtgtgcggggctggggcctacatctgtggagaggagacaacgctcatcgagtccattgagggcaagcagggcaagccccgcctgaagccccccttccccgcagacgtgggagtgtttggctgccccacaactgtggccaacgtggagacagtggcagtgtcccccacaatctgccgccgtggaggtacctggtttgctggctttggcagaaaacgcaactcatgcaccaaactattcaacatctctggccatgtcaaccacccttgcactgtggaggaagagatgtctgtgcccttgaaagaactgat

SEQ ID NO: 12715 - DNA, 508 bp, Homo sapiens
ggccgccatcatcctcacctatgatgtgaatcaccggcagagcctggtggagctggaggaccggttcctgggcctgacagacacagccagcaaagactgcctcttcgccatcgtggggaacaaagtggacctcactgaggagggggccttggcgggccaggagaaggaagagtgcagtcccaatatggacgctggggaccgtgtctccccaagggcacctaagcaggtgcagctggaggatgcggtggccctttataaaaagatcctcaagtacaagatgctggatgagcaggatgtgccggccgctgagcaatgtgctttgagaccagcgccaagaccggctacaatgtggacctcctgtttgagaccctctttgacctggtggtgccaatgatcttacagcaaaaagctgagaggccgtcacacacagtggatatatccagtcataagccacccaagaagaccagatctgggtgttgtgcctgactttcgagggcctcctggactc

SEQ ID NO: 12716 - DNA, 599 bp, Homo sapiens
tgagactcaccggccgcacgccatgagggccctgtgggtgctgggcctctgctgcgtcctgctgaccttcgggtcggtcagagctgacgatgaagttgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagtttgccttccaagccgaagttaacagaatgatgaaacttatcatcaattcattgtataaaaataaagagattttcctgagagaactgatttcaaatgcttctgatgctttagataagataaggctaatatcactgactgatgaaaatgctctttctggaaatgaggaactaacagtcaaaattaagtgtgataaggagaagaacctgctgcatgtcacagacaccggtgtaggaatgaccagagaagagttggttaaaaaccttggcaccatagccaaatctgggacaagcgagtttttaaacaaaatgactgaagcacaggaagatggccagtcaacttctgaattgattg

SEQ ID NO: 12717 - DNA, 646 bp, Homo sapiens
tacggccgggcttgggctgcgtggagatactttttgcgatgcctactggagactttgatttccgcagttcgaagcccagttgggccgaccaggtggaggaggagggggaggacgacaaatgtgtcaccagcgagctcctcaaggggatccctctggccacaggtgacaccagcccagagccagagctactgccgggagctccactgccgcctcccaaggagggcatcaacggaaacataaagacagtgacagagtacaagatagatgaggatggcaagaagttcaagattgtccgcacctccaggattgagacccggaaggcttcaaaggctgtcgcaaggaggaagaactggaagaagttcgggaactcagagtttgacccccccggacccaatgtggccaccaccactgtcagtgacgatgtctctatgacgttcatcaccagcaaagaggacctgaactgccaggaggaggaggaccctatgaacaaactcaagggccagaagatcgtgtcctgccgcatctgcaagggcgaccactggaccacccgctgcccctacaaggatacgctggggcccatgcagaaggagctggccgagcagctgggcctgtctactggcgagaaggagaagctgccgggagagct

SEQ ID NO: 12718 - DNA, 399 bp, Homo sapiens; identical to SEQ ID NO: 1447

SEQ ID NO: 12719 - DNA, 515 bp, Homo sapiens
ccgccgtgttttgggccggttctggagtggctggcggcggggcctgggtgtccgcccagtgcccgaggacgcaggctttggcaccgaagcccggcatcagaggcaaccccgcggctcctgccaacggtcggggcccctcggggaccagcccttcgcggggctgctgccaaaaaacctcagtcgggaggagctggttgatgcgctgcgggcagccgtggtggaccggaaaggacctctagtgacgttgaacgagccacagggtctaccagtgacaggaaaaccaggagagctgacgttgttctcagtgctgccagagctgagccagtccctagggctcagggagcaggagcttcaggttgtccgagcatctgggaaagaaagctctgggcttgtactcctctccagctgtccccagacagctagtcgcctccagaagtacttcacccatgcacggagagcccaaaggcccacagccacctactgtgctgtcactgatgggatcccagctgcttctg

SEQ ID NO: 12720 - DNA, 400 bp, Homo sapiens
ggtggcaggtggctccagccccgggcctggctggggttcccagacgcctggggcctccccaccccgcagcaggcccggggcaaggctcgcgggaatgagtatcagccgagcaacatcaaacgcaagaacaagcacggctgggtccggggggggagcacgccggccggcgtgcaggtcatccttcgccgaatgctcaagggccgcaagtcgctgagccattgaggatcgcgacgcagtcggcgggaccctcatggaagcatcgcccccgcctcggaccttgcctggcgctatttttgcagggagctggggagcaagaacgcctcggacctgagtgctctccatattgtggggttgaagtctggatgggagcttgccaaatccctttttaggctttttaatt

SEQ ID NO: 12721 - DNA, 452 bp, Homo sapiens
agcagatacaaaaattggctgggtgtggtgccacatgcctgtaattccagctacttgggaggctgaggcatggagaatcgcttgaacccaggaggcagaagttgcagtgagcagagatcacaccactgcactccagcctgggcaacagagtaagactccatccacacacacacacacacacacaaaattgaaaagtgaagacattttaatggagatttaatagtgcttccacactaatgaactaatggagttttggctccactcatgagtgtatttgaaatgtaagtaaccagctacaaagaataatgtcacttcatttgattatgactaccaatcaagagaaggaggaatacatttctgaggagtgatactaaaccatttgagcttaaatgagtacctgattttgcagcccttaaaacgagtcaataactatgtggaaatatagaaaaata

SEQ ID NO: 12722 - DNA, 557 bp, Homo sapiens
tccgtggcaatgaattcttctgtgaagtggatgaagactacatccaggcacaaatttaatcatactggactcaatgggcaggtccctcactatcgacaagctttagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagct

SEQ ID NO: 12723 - DNA, 489 bp, Homo sapiens
gaagaagagtcccacgaactggctgggtatacagaaatgtccagaggccggagagcgtttcagatcacatgtaccggatggcagttatggctatggtgatcaaagatgaccgtcttaacaaagaccgatgtgtacgcctagccctggttcatgatatggcagaatgcatcgttggggacatagcaccagcagataacatccccaaagaagaaaaacataggcgagaagaggaagctatgaagcagataacccagctcctaccagaggacctcagaaaggagctctatgaactttgggaagagtacgagacccaatctagtgcagaagccaaatttgtgaagcagctagaccaatgtgaaatgattcttcaagcatctgaatatgaagaccttgaacacaaacctgggagactgcaagacttctatgattccacagcaggaaaattcaatcaccctgagatagtccagcttgtttctgaacttgaggcag

SEQ ID NO: 12724 - DNA, 622 bp, Homo sapiens
tacggccggtgacactgttaaattactattacattccatcacaggaggaattatgcatcagcttgttctcatgtgattctcatgtgccaaaaagtattttctgagccaataaaaagaaaattattttttcagtagtttttaaatcttcctgtgtccccaaaatgtctccatgaatttaatgtcaaattaaaaaccaagccaaggctgggtacagtggtgcacacttgtagtcctggctacacgtggggctgggacaaggggatcacttgagcccaggagttcaaggctgtaatgctttatgatcatacctgtgaatagccactgcactccagcctgggcaacacagtgagacctcgtctctaaaattattagaggctgggcacagtggctcacacctgtaatcccagcactttgggaggctgaggcaggcggatcacttgaggtcaggagttccagaccagcctggccaacatggtgaaactccgtctctactagaaatacaaaaattagccgggcatggtggcaggtgcctgtaatcccagctagtcgggaggctgaggcaggagaatcacttaaacccgggatggggaggttgcagtgagccaatatcgcatcactgctc

SEQ ID NO: 12725 - DNA, 619 bp, Homo sapiens
ggccgggtgcagtggtgtcatcttggctcactgcagcctctacctcctgggttcaagcgattctcatgccttagcctcctgagtagctggaactacaggcgtgcaccaacacgcccagctaagttttgtatttttagtagagacagggttttaccgtgttggccaggctggtcttgaacccctgacctcaagtgatccactcgcctcagcctcccagagtgctgggattacagcgtgagccaccacgccctgccactcctatttaatcttcaaaacaatcctataaagttgattaaaggcgtcctagttttataaataaagaaaaggaaagggtcagagatgttcagttatgggcaaaattacatagctgggatttgatccatgtttttagatgcattttgataacagtaggagcaggaacatggaaagtggagagcgagaattaagtaggtcttggaattcagttggaaagagggagggaatcctcagttggaaatttctcagttggaaagagggaaagtgtatttgaaatgaccaattctagctatgttaggaatctgtgagtgactgactgactgactgcctgactgcctcagttacctgcttacttctttccttc

SEQ ID NO: 12726 - DNA, 455 bp, Homo sapiens
tacggccgggtgcagcggctcaacccaagtcccagcactttgggaggccgcggtgggcagatcacgaggtcaggagttgacacgagcctggccaatatggcgaaaccccatccccaccaagaatacaaaaatcagccgggcatggtggcacacacccgtagtcccagccactcagaggccgaggcagaggaactgcccgaacccgggagacggaggttgcagtgagccaagattgtgccattgcactccagcctgggggacagagcgaaactctgtctcaaaaaatatatgtgtgtgtgtgtgtgtgtgtgtgtgtgtgtgtgtgtgtgtgtgtatctatatatatctcaaaaataagagatcatttgagagattatcattataaaagacaagatagtgttcaacttagtgactaatttaattatctctatgggactttgtgtacactacacaga

SEQ ID NO: 12727 - DNA, 532 bp, Homo sapiens
atgaatgtaaaagggaaataaaagtcttttgaaggtagctatactagcacttttgatcattcttcagggcccacaaaaatgttgtcaagaattttaaaggtttataattctgcttaagctctagtttggacttaggtatcctaactatgttggaggtatttgcattgttttaagttaggataaaagcaagttcctcctgtgactgcaacgtcttactgattgggacagttgccaggaggataccaacttgatagcagagggggttttatgcaaacgcactcacctccgccttggggaatgaaagggtcacttctgcatcatcactagctagttttctagtgttagagaggcttacaaatgtttgccattctcataagtgttttgaacttgatctttgtgacttgtgctttttagcttctctcttgaatcagagtatcattgtcttcctccaaggagttagaatttcccagtttaaaacaaaaagggaaatgtcctaggttttctttgtgcttctcatttttcctttgttgat

SEQ ID NO: 12728 - DNA, 547 bp, Homo sapiens
tacggccgggacatgaggtgtactgaagggtcacagcagagtgagttcctggtgtatccacaaggaaatgagcacggaactctcacaacagcgtgtgtgctgtgcgctgtgcttgaatagctgactgctcctttatacacagcctctgtgctgggattacaggcatgagccaccgcacctggccattcatttcttttaaactaagacattgtgccataagcctgatttaatgttcacatttgtgattaagtagtagaattttgctagtagacctctttcttttcagaagaccagtgaaataccaggtctgagtaaagtaatccttttaaaaggtagcattttccatgtcatatgtgcatatacacacacacattttatgtattatatataaaaaatatgtatattatatagaaattacatcaacaattaaattcctcatttttttaagaagataaaaaactgtctcaatattaacaaggaaggtcaagtgagaacttacatgcacacctctggttaataatgtgtatcatatattctttctggaaag

SEQ ID NO: 12729 - DNA, 483 bp, Homo sapiens
gggggcgcagcgcgcacgcaatcgcgtttccggagagacctggctgctgtgtcccgcggcttgcgctccgtagtggactccgcgggccttcggcagatgcaggcctggggtagtctcctttctggactgagaatattttaatggagaagcccctcttcccattagtgcctttgcattggtttggctttggctacacagcactggttgtttctggtgggatcgttggctatgtaaaaacaggcagcgtgccgtccctggctgcagggctgctcttcggcagtctaaccggcctgggtgcttaccagctgtatcaggatccaaggaacgtttggggtttcctagccgctacatctgttacttttgttggtgttatgggaatgagatcctactactatggaaaattcatgcctgtaggtttaattgcaggtgccagtttgctgatggccgccaaagttggagttcgtatgttgatgacatctgatt

SEQ ID NO: 12730 - DNA, 325 bp, Homo sapiens
tcaggagtttgagaccagcctaaccaacatggtgaaaccccatctctactaaaaatgcaaaaattagctgggtgtggtggcgcatgcctgtaatcctagctactcaggaggctgaggcaggagaatcacctgaacccaggaggcggaggttgcagtgagctgagatcgcaccattgtactccagcctgggtaagaagagcgaaactccatctcaaagaaaaaaaaaaaaaaaaaaaaaaaaaaaaaaaaaacttttgggggccccccccccttttgggggggctttttttgacccccccccctaaaaaaaaccttgggggggggg

SEQ ID NO: 12731 - DNA, 510 bp, Homo sapiens
  misc_feature 233: n = A,T,C or G
tacggccgggtgtggtggttcaacctgtaatccagcactttgggaggccgaggcaggtagatcatgaggtcagaagatcaaaaccatcctggctaacacggtgaaaccccatctctactaaaaatacaaaaaattagccgggtgtggtggcacacacctgtagtcccagctactcgggaggctgaggcagaagaatcgcttgaacctggaggtggagggtgcagtgggccaanatcgcaccactgcactccagcctgggtgacagagcgagactctgtctcaaataaataaattatttcacagaggatagcaagctccagaaggttctattacctttaaaaaagagtagttttgcccctcccagcaacctggtatgggtgccctaagaccagtctgaactcacactgtctgaaaggccacccaggatccaaatcgggccatcttcattgccatgagtgttcggacaggctctgcgtgccaggcaaccgtgggcagacaaagggctccctg

SEQ ID NO: 12732 - DNA, 568 bp, Homo sapiens
gttccgggcgttccatcgtccgtgcgcaccgcccggcgtccagatttggcaattcttcgctgaagtcatcatgagctttttccaactcctgatgaaaaggaaggaactcattcccttggtggtgttcatgactgtggcggcgggtggagcctcatctttcgctgtgtattctctttggaaaaccgatgtgatccttgatcgaaaaaaaaatccagaaccttgggaaactgtggaccctactgtacctcaaaagcttataacaatcaaccaacaatggaaacccattgaagagttgcaaaatgtccaaagggtgaccaaatgacgagccctcgcctctttcttctgaagagtactctataaatctagtggaaacatttctgcacaaactagattctggacaccagtgtgcggaaatgcttctgctacatttttagggtttgtctacattttttgggctctggataaggaattaaaggagtgcagcaataactgcactgtctaaaagtttgtgcttattttcttgtaaatttgaatattgcatattgaaatttttgtttatgatctatga

SEQ ID NO: 12733 - DNA, 531 bp, Homo sapiens
ctgaggcagggagaattccttgaatccggtaggcagaggttgcagtgagccaagatggtgccactgcactccagcctgggctgcaaaacaagactctgtctcaacaacaacaacaacaacaacaacaacaacaaacaaatttagtgaatccaggtaattttatatgacctgtatatgtataatagttttaatctttgaaaattttttgagcagaaaaggctcataatgttaagtttccagactgagatcagcagactacatgaagaataacttagagtccaacttggcaggagtgaactgaaactgagcacagagctaggaaacttgaaggaataatttgatatactttttacaacagtggaaagatgggaggcagggaaccctacagacctttaaggtcttttgagctacaaaatttaaaaaggagcaaaatattagaacagttgtcagttatttttaatcaatgaaaaaccacctaaacttggttagctcgaaagaaataacaaaagaagacatattggagcatctaaa

SEQ ID NO: 12734 - DNA, 57 bp, Homo sapiens
tctccacgtctccagaacaagattccacctgggagtttcttagactgattcttgacc

SEQ ID NO: 12735 - DNA, 616 bp, Homo sapiens
atcaaacttggtctgggtattgatgaagatgaccctactgctgatgataccagtgctgctgtaactgaagaaatgccaccccttgaaggagatgacgacacatcacgcatggaagaagtagactaatctctggctgagggatgacttacctgttcagtactctacaattcctctgataatatattttcaaggatgtttttctttatttttgttaatattaaaaagtctgtatggcatgacaactactttaaggggaagataagatttctgtctactaagtgatgctgtgataccttaggcactaaagcagagctagtaatgctttttgagtttcatgttggtttattttcacagattggggtaacgtgcactgtaagacgtatgtagcatgatgttaactttgtgtggtctaaagtgtttagctgtcaagccggatgcctaagtagaccagatcttgttattgaagtgttctgagctgtatcttgatgtttagaaaagtattcgttacatcttgtaggatctactttttgaacttttcattccctgtagttgacaattctgcatgtactagtcctctagaaataggttaaactgaagcaacttgatggaaggatct

SEQ ID NO: 12736 - DNA, 622 bp, Homo sapiens
ctctccagagtggccctgtcagtgaacccaggctgaagaccacaggttaatctttgcccaggctggccttggtggcagagctattgtggacgatgaaaggctctctgcagaggagatggatgagaggaggcggcagaacattgcttatgaatatctgtgccacttagaggaagccaaaaggtggatggaagtttgcttagttgaagaattgccaccaaccactgaattggaagaagggctccggaatggagtttaccttgcaaagttagccaagttctttgccccgaaaatggtgtcagagaaaaagatctatgatgtggaacaaacacgttataagaagtctggccttcattttcgacacacagataataccgtccagtggttaagagcgatggagtctattggtctacccaagatattttatccagaaacaacagatgtctatgatcggaaaaacataccaagaatgatatattgcattcacgcactgagtttatatctgttcaaactaggaatagcaccccagatccaggatttgttgggcaaagtagacttcacagaggaggaaatcagtaatatgagaaaagaacttgagaaatatggaatacagatgccatctttc

SEQ ID NO: 12737 - DNA, 383 bp, Homo sapiens
agctaactggattccattcatacagatgtacaggggagttggggtgggggttatcttcttttattttagaatattaaaacaaaattattacattaagactgccacaatcatttaattcaatgacaagaatcatctttaaatggctggttgagaggcagtcccagtagagaattaagtggcctgaacagaagactgactttgccaaccaccttgaccatgagaaaatgatttctgtcctcagcaagccgccctgtcctgtgtgtttttgaggaaagcacatgcaaagagacatagaaacgttttgtaattagctgcacttttagatttgaaaaacaaataaaaacgatagggagctaatatggtccaggaagtacagagagtaa

SEQ ID NO: 12738 - DNA, 457 bp, Homo sapiens
tttttttttttttttttttttttttggccgggcgtgatggtgggcgcctgtattcccagctactcaggaggttgaggcaggagaaatcgcttgaacctgggaggcggaggttgcagtgagctgagatcgtgccactgcattgcagtctgggctacagggcgagactccgtctcaaaaaacaaacaaacaaacaaaaaacagtaatccgaactgatttaaacttctttattaacagaatatatgttcaaacaaagcttaaagtcccattttctttccattggcgtccaggcccctattactcaactatccgttggttagggcctgcacctcaaggtaggcttaattgtaaatcaaaatatttactatccacacttagagggctatctgtaacatcgtttttatttacccccgtccattcgataatcgtctgaaatgcaagacattaagttgaacatca

SEQ ID NO: 12739 - DNA, 420 bp, Homo sapiens
tttttttttttttttttttttttgagagtcactgctgctttatttacatgcgtcaccatctcttttacaaactagattacggttttaagtggaatacacaaggcaatatctacaaacaccaaggaaagttaagtactgcatctctatttcatttggaaaggggaagattcccaaatcaaactggttttgatccttaagaaaggcggcagagttaattcatggcaacatatggttagacaaaatcctcagtaagaatgccatatgatagtgttcgcattgaaagaaggatgaggtgcttcaaatcaaagtctcaactgcttgactctcaggtgtttaaatatggccacacaccatatttagttctagattatatgggatatgagcaaggaattgaaacagataagatagtttttacagata

SEQ ID NO: 12740 - DNA, 596 bp, Homo sapiens
tagcagaggactttttagctgctcactggccccgcttgtctggccgacttatccgcccgcgacccctaatcccctctgcctgccccaagatgctgaagccagccctggagccccgagggggcttctccttcgagaactgccaaagaaatgcatcattggaacgcgtcctcccggggctcaaggtccctcacgcacgcaagaccgggaccaccatcgcgggcctggtgttccaagacggggtcattctgggcgccgatacgcgagccactagcgattcggtcgtggcggacaagagctacgagaagatccacttcatcgcccccaaaatctactgctgtggggctggagtagccgcggacgccgagatgaccacacggatggtggcgtccaagatggagctacacgcgctgtctacgggccgcgagccccgcgtggccacggtcactcgcatcctgcgccagacgctcttcaggtaccagggccacgtgggtgcatcgctgatcgtgggcggcgtagacctgactggaccgcagctctacggcgtgcatccccatggctcctacagccgtctgcccttcacagccctgggctctggt

SEQ ID NO: 12741 - DNA, 542 bp, Homo sapiens
atacaaagacagcacgctaataatgcaattactgagagacaacttgacattgtggacatcggatacccaaggagacgaagctgaagcaggagaaggaggggaaaattaaccggccttccaacttttgtctgccttattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttaaggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggagtaaaagggatcattggttccagtcacaggtgtagtaattgtgggtactttaaggtttggagcactta

SEQ ID NO: 12742 - DNA, 551 bp, Homo sapiens
acggccgggattcatatgtaatactgcagagaagttaattggatatggttatgaagaaattattagagaaattgcatatgtcaaggcagaagggtctcagtttgtgtttaggaggagggctgcaagtaatatgaaaaagaagaggattttgggattgaggtcccctgggagtgttgagaagttgaattctagagctgtggttcctgacctacaagccctgaagttgttacagggtgttcattgcttattcatatgcttataactttgtctgtaagttgaataaagattgttctagatcattgaataataaaaatttaacccattgttgtgaaggagcctcagaatattttgatgttaacaaaagagttctgtatttacaaagttggagaaacactcatcaagagttaggagtaaggcccagtgtggggttccctctggtaataccagcattttgggaggctgaggtgggcgaatcacttgaggtcaggagtttgagaccagcctggccaacatagcgaagccccatctctactaaaaatacaaaaattagc

SEQ ID NO: 12743 - DNA, 546 bp, Homo sapiens
aggaaaaagaggaaaccagtcggggaagaatgtgatggtggagccgcatcggcatgagggtgtcttcatttgtcgaggaaaggaagatgcactggtcaccaagaacctggtccctggggaatcagtttatggagagaagagagtctcgatttcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgttcgacacccacacaagtaccgcatgctcatcgcaatggtggatgtgatctttgctgatgtggcccagccagaccagaccccgattgtggccctgaatgcccacaccttcctgcgtaatgg

SEQ ID NO: 12744 - DNA, 407 bp, Homo sapiens
caagatggcggccgtggggcgagtcggctccttcggttcttctccgccgggattatcctcgacttacactggcggccccttgggcaacgagatagcgtcgggcaacggtggcgccgcggcaggcgacgacgaggacgggcagaacctttggtcctgcatcctcagcgaggtctccacccgctcgcgctccaagctccctgcggggaagaacgtgctactgctgggtgaagatggagctggaaaaacaagcttaataagaaaaattcagggaatagaggagtataagaaagaaagagaaaatcagttcgtggttgcattgtggatgcaaatctgagcgttctcaacttggttattgtaaaaaaaggagagaaggatattcctggactgactgatactacagtgcctcg

SEQ ID NO: 12745 - DNA, 448 bp, Homo sapiens
  misc_feature 100, 101: n = A,T,C or G
aatggtgggaatcattacaaaacattatgaatatagttaaagcaactgaactgtacacttaaaatagttaatgtgatacattttatgttacatgtatttnntgcccactgaaaaaataaaaatatataaacacacagcaaatgatgaccaggcctttgaagaaagcttataaaacaaaattaagaagccaaggctgggagtggtggctaacgcctgtaatcctagcactttgggtggctgagatgggcggatcacgaggtaaagacatcgagaccatcctggccaacatggtgaaatgtatgtttagtctctactaaaaatacaaaatttagctgggtgtggtggcatgtgcctgtagtcccagctactgaacccgggaggtggagattgcagtgagctgagatcgcgccacagcactccagcctggctacagagcgagactctgtct

SEQ ID NO: 12746 - DNA, 587 bp, Homo sapiens
tccgggcccgcggcaacctcgggcgctgttctgcaggccgcgaccggcatgtacgagcaactcaagggcgagtggaaccgtaaaagccccaatcttagcaagtgcggggaagagctgggtcgactcaagctagttcttctggagctcaacttcttgccaaccacagggaccaagctgaccaaacagcagctaattctggcccgtgacatactggagatcggggcccaatggagcatcctacgcaaggacatcccctccttcgagcgctacatggcccagctcaaatgctactactttgattacaaggagcagctccccgagtcagcctatatgcaccagctcttgggcctcaacctcctcttcctgctgtcccagaaccgggtggctgagttccacacggagttggagcggctgcctgccaaggacatacagaccaatgtctacatcaagcacccagtgtccctggagcaatacctgatggagggcagctacaacaaagtgttcctggccaagggtaacatccccgccgagagctacaccttcttcattgacatcctgctcgacactatcagggatgagatcgctgg

SEQ ID NO: 12747 - DNA, 563 bp, Homo sapiens; identical to SEQ ID NO: 1526

SEQ ID NO: 12748 - DNA, 578 bp, Homo sapiens; identical to SEQ ID NO: 1530

SEQ ID NO: 12749 - DNA, 472 bp, Homo sapiens
aggcccaagctaaccttctccattggttgtgcggctcacaagtgaaggaagcaccctttctggctgtgacattgaacttgttggagcagggtatcgattttcactcatcaagaaaaggtttgctgcaggaaaatacttggcagataactaatgaaatcttatgcaaggatttggaggattcatataatggagaactgatgtatgagaaacagattttaattttggtttgatgaaaacaaaccaatatctgcacttgggatatatcaggtggaaagtcaatgactttcatctgtgatttccctcacacactaccatgatgaccagtcctacagtatttacttctaggcgtaatattgttaatggtcttaaaatgtaattattgtatttgtaaattgtactctcattccagtaaggcagttagacacttgacttttagcattttaccattcctgaaatggatgtaatttaaact

SEQ ID NO: 12750 - DNA, 565 bp, Homo sapiens
tacggccgggacaggtcattaatagcatctgggctctatggctacaatgccaccctggtgggagtactcatggctgtcttttcggacaagggagactatttctggtggctgttactccctgtatgtgctatgtccatgacttgcccaattttctcaagtgcattgaattccatgctcagcaaatgggacctccccgtcttcaccctccctttcaacatggcgttgtcaatgtacctttcagccacaggacattacaatccattctttccagccaaactggtcatacctataactacagctccaaatatctcctggtctgacctcagtgccctggagttgttgaaatctataccagtgggagttggtcagatctatggctgtgataatccatggacagggggcattttcctgggagccatcctactctcctccccactcatgtgcctgcatgctgccataggatcattgctgggcatagcagcgggactcagtctttcagccccatttgaggacatctactttggactctggggtttcaacagctctctggcctgcattgcaatgg

SEQ ID NO: 12751 - DNA, 113 bp, Homo sapiens; identical to SEQ ID NO: 1537

SEQ ID NO: 12752 - DNA, 53 bp, Homo sapiens
aaataagctaccatatagcttacaagtctcaaatttttgccttttactaaaat

SEQ ID NO: 12753 - DNA, 589 bp, Homo sapiens
ttttttttttttttttttttttttcctaaaaagggatggtcaagtttttgaatttaagattttattctcacttcgtctgtttagatttgttatatcagagcctttctttacttattaacaatctcttgtagtaaacatgtgtaatctgatttccttcaactttctccaaactcaaatatctacaaatcaccttcatgtcttcatactattttggaaaatagtttctccagttctcaaatgttactgagtgtatttccatgtcccaggagcttggcaatttttttctatcataattggcaataccaggaatgggctaattgcctttggaggtcagaacttctttagtatttttatttttttattggtcttgggtcactagaaggaactgttactgtgtcctggctgtggctagcagtgacaagactgtcttttgagggcgctgccaggcttaattgcatccaatatagggatcttcatctgagatttggaacaatgaatcttccatgccaattaaagatgagtttaatatagagaatatgaagtatgcctagcagaggaacagttttacagagcctcaggatcccatctg

SEQ ID NO: 12754 - DNA, 607 bp, Homo sapiens; identical to SEQ ID NO: 1553

SEQ ID NO: 12755 - DNA, 470 bp, Homo sapiens
cagttgtctgctgtctgtaattcagtttgcgtgtattttatgctcatgcaccgacccatacagagtaaatcttttatcaactatatactggtgtttaatagagaatgattgtcttccgagttttttggttccttttttaactgtgttaaagtacttgaaatgtattgactgctgactatattttaaaaacaaaatgaaataatttgagttgtattacagaggttgacattgttcagggatgggacaaagccttcttcaatccttttcatactacttaatgattttggtgcaggaacctgagattttctgatttatatttcatgatacttcacatttgctcttcacagcatgagcatgaagcccagtggcaccaaatggctgggtacaatcaagtgatattttgtagcacctcactatctgaaaggccatgagttttcagatgatttcattgagcttcattgcagcctgaa

SEQ ID NO: 12756 - DNA, 393 bp, Homo sapiens
gcagtgatggaagccagaaggaatgaaggcctgcagtgaggatggagtggtcggcctgaagccatctctagcaagtggtcaggacgctgattgttctgcgcaggttggaggtaggtggtgagtctgagaaaggggccggaaagactccccagcaactgctggcaaagggtgaagggcacgttcccacaggattcaagccagctgcctttggaggggagacgggcactcagtttaggcgctcctacagcagggtcagcaagacaagcaggttgcggcaagggtctgcgcactgctgtgtaaatgtaggggcatcggggggcagaaagaccaggggagaagtgtgcatcacccttggggttaagggacagttgtctgctaggtgttgcttcctgg

SEQ ID NO: 12757 - DNA, 465 bp, Homo sapiens
gaggaggacccagaagaagaacatgagctgcctgtggacatggaaaccatcaacctggacagagatgcagaggatgttgatttgaatcactatcgcatagggaagattgaaggatttgaggtactgaagaaagtgaagactctctgcctccgccaaaatttaattaaatgcattgagaatctggaggagctacagagtcttcgagagctggatctttacgacaaccagatcaagaagattgagaatctggaggcgctaacagagctggagattctagatatttcttttaatctgctgagaaacatcgaaggggttgacaagttgacacgactgaaaaaactcttcttggtcaacaataaaatcagtaaaattgagaacttaagcaacttacatcaactacagatgctagagctgggatctaaccgcatccgggcaatcgaaatatcgacaccttaaccaacctgg

SEQ ID NO: 12758 - DNA, 427 bp, Homo sapiens
aaaagatatgggttctgtagccttggatgcagggactgccaaagacagcttatctcctgtgctgcacccttctgatttgatcctgactcgaggaaccttggatgaagaggatgaggaagcagacagcgatactgatgacattgaccacagagttacagaggaaagccatgaagagccagcattccagaattttatgcaagaatcgatggcacaatactggaagagaaacaataaataggagactttagcacacttcacttgtttctagaagtccagaattttggacctccacgtgaaagaactgttcttacctctgagctgggggctcccataagggataattgtcctcagagtagcaaagtttctcttattagagaaatcttgtgactcacatgaagtcagggatagaagacccttggacctggca

SEQ ID NO: 12759 - DNA, 567 bp, Homo sapiens
tagagggggatatgatagtctgcgcagcgtatgcacacgaactgccaaaatatggtgtgaaggttggcctgacaaattatgctgctgcatattgtactggcctgctgctggcccgcaggcttctcaataggtttggcatggacaagatctatgaaggccaagtggaggtgactggtgatgaatacaatgcggaaagcattgatggtcagccaggtgccttcacctgctatttggatgcaggccttgccagaactaccactggcaataaagtttttggtgccctgaagggagctgtggatggaggcttgtctatccctcacagtaccaaacgattccctggttatgattctgaaagcaaggaatttaatgcagaagtacatcggaagcacatcatgggccagaatgttgcagattacatgcgctacttaatggaagaagatgaagatgcttacaagaaacagttctctcaatacataaagaacagcgtaactccagacatgatggaggagatgtataagaaagcccatgctgctatacgagagaatccagtctatgaaaagaagccca

SEQ ID NO: 12760 - DNA, 649 bp, Homo sapiens
tatttagttactgatttacagtaacccctccttattatgggggatacattccaaaaccatcagtggatgcctggaactgttaatagtactgaaccctatatagcactatcttttttcctatacatacatacctatgataaagtttaatttgtaagagattaataatgactaataataaaacaattatgacagtatattgtaataaaagttgtatgaatgtggtctctcagaatatcttagtatactgtactcacctattttcagaccatggttgactgtagataactgaaactgtgaagagcaaagccatggataagagagactactgtatctggttttttgttttgagaaacagctggtcttattatgtatcaggtctaaatctgcaggtctaggccaggtgcagtggctcatgcctgtaatccaagcactttgggaggctgaggcgggtggatcacctgaggtcaggagttcgagaccggccaggccaacatggtgaaaccccgtctctgttaaaaatacaaagattatccaggtatggtggcacacccctgtaatcccagctacttgggaagctgaggtggcagaattgcttgaacccggaaggcggagggtgcagtgagccgagatcatgccactgcactccagc

SEQ ID NO: 12761 - DNA, 608 bp, Homo sapiens
ttggcattgtgtctggaatgcccaatgtcaaatgggaccggattgcccctgctagcaatgtctcccacactgtggtcctgtgccctctcaaggctggttatttcaacttcacctcggcaacaattacttacctggcccaggaggatgggcccgttgtgattggctctaccagtgcacctggacagggaggaatcctggctcagcgggagtttgacaggcgattctcccctcattttctggactgggcagcctttggggtcatgacccttccccccatcggcatccccctgctattgtggtactcagcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctgcgagagcctccttggttccatcgtgaagccataaacaggaatgcctttggcaatagccttgagcctagtgggccctctgatg

SEQ ID NO: 12762 - DNA, 639 bp, Homo sapiens; identical to SEQ ID NO: 1567

SEQ ID NO: 12763 - DNA, 550 bp, Homo sapiens
agctcgaggccatgagcagatgtaccagcccagtgaacccagctgtcttcccccatctgaccgtggtgcttttggccattggcatgttcttcaccgcctggttcttcgtgtatcctttcactgagcagccagaggaccagcattagtgatgtgggaagctcagggagaaaccacgctaggtacatggaccccgccggttttgtacattggattggggctgagagaagattgccgtgggctgggctctctgcactccacagtccaccccttcgctttgccttaactgctgtgcccagttacgaggtcacctctaccaagtacactcgtgatatctataaagagctcctcatctccttagtggcctcactcttcatgggctttggagtcctcttcctgctgctctgggttggcatctacgtgtgagcacccaagggtaacaaccagatggcttcactgtaacctgcttttgtaaattacttttttttactgttgctggaagtgtcccacctgctgctcataataaatgcagatgtatagtaaaaaaaaaaaa

SEQ ID NO: 12764 - DNA, 331 bp, Homo sapiens
ttttttttttttttttttttttttttcttttggggggagccctttgaggaatccccttggcctgcatctcatcatttatgaaatttctaagtgtgcgtcgaatgtaaatacgagccaagtcctgtagattcctgacagcacagggagggagtcccacagaatctggtttgccattatcattcttacttggttgcacaagtggagcaaatgaaacagcaaggatatttttactttcccaagtgttctgtccagttcgcataatctgtgttaactgatcctctataggcatgactaatatgcctccaacttttagtaatattttcatgtagtt

SEQ ID NO: 12765 - DNA, 434 bp, Homo sapiens
tttttttttttttttttttttttttctgagacgctaatttttgtatttttagtagagacagggtttcaccatgctggccaggctggactcaaactcatgacttcaggtgatccgcctgccttggcctcccaaagtgttgggaatacaggcatgagccaccacgcccggcctaaattcaatatgaaatagaaacgcagccacagagtctgcccatatcctggtcattgcatgttttgtgtggaacttctgggagggactttgatgaccttgtacttttgttttaacagtcactgttatcgcaataataaaaacctatttcagttgaagccctaccctttgccagctgtatgaactgcaataaattactttatttccctgtttacttttctatctgtaagataaataaaataacactaccttcctttcaggataca

SEQ ID NO: 12766 - DNA, 573 bp, Homo sapiens
tttttttttttttttttttttttttgtgtcacccaggctggactagtggtgtgatatcagctcactgcaacctctgcctcccagattcaaggattctcctgcctcatcctcctgagtaactgggactacaggcacacgccaccacattggccaggccggtcttgaactcctggtgccaactgatccacccgcctcaacctcccaaagtgagccctgcctgacacctgtttttggtatcaggaaaaaaaacatcactaacgttatttttaaaaatccacttggctgttatctccatagatgaaaaaaactctatcctaaattaaaactagcatgtacacataatttttaaaacgttaactgagaatttctacaaatctgtattttcagaaaataatttccaaagttctaccattaacgtatgcaagaaatataatcaagaaaaaaatcatttttaattttttctgaaacagccagttttaattattgtacaaatacaactagttttcactaagccatttggcagtaagttagtaacctgatgactaatcgccctgattactttcgtttataatt

SEQ ID NO: 12767 - DNA, 533 bp, Homo sapiens
tgtagtggcttcgtcttcggtttttctcttccttcgctaacgcctcccggctctcgtcagcctcccgccggccgtctccttaacaccgaacaccatgccttcaattaagtcgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactg

SEQ ID NO: 12768 - DNA, 391 bp, Homo sapiens
cctgtggcgagggcatttgaagccaccggcgttgagtacttcaacacgtttgggggcagcccagtgtcctgcgctgtggggctggccgtcctgaatgtcttggagaaggagcagctccaggatcatgccaccagtgtaggcagcttcctgatgcagctcctcgggcagcaaaaaatcaaacatcccatcgtcggggatgtcaggggtgttgggctcttcattggtgtggatctgatcaaagatgaggccacaaggacaccagcaactgaagaggctgcctacttggtatcaaggctgaaggagaactacgttttgctgaacactgatggccctgggaggaacatcctgaagtttaagcccccaatgtgcttcagcctggacaatgcacggc

SEQ ID NO: 12769 - DNA, 595 bp, Homo sapiens; identical to SEQ ID NO: 1590

SEQ ID NO: 12770 - DNA, 527 bp, Homo sapiens
cactccctgaggcagtggcgacagcggcggcgagaggatgaacaacaagttcgacgctttgaaagatgatgacagtggggaccatgatcagaatgaagaaaacagcacacagaaagatggtgagaaggaaaaaacggaacgagacaagaatcagagcagtagcaagagaaaggctgttgtccctggaccggcagagcatcccctgcagtacaactacactttttggtactccaggagaacccccggccgtcccacgagctcacagagctatgaacagaatatcaaacagattggcacctttgcctctgtggagcagttctggaggttttatagccacatggtacgtcctggggacctgacaggccacagtgacttccatctcttcaaagaaggaattaaacccatgtgggaggatgatgcaaataaaaatggtggcaagtggattattcggctgcggaagggcttggcctcccgttgctgggagaatctcattttggccatgctgggggaacagttcatggttgggg

SEQ ID NO: 12771 - DNA, 499 bp, Homo sapiens
tacggccgggaccccatctctactaaaatacaaaattagctgggcatggtggtgtgtgcctgtaatgctagctactcaggaggctgaggcatgagaatcgcttgaaccggggaggcagaggttgcagtgagccgagatcgcaccactgtactccagcctgggcgacggagtgagactccctctcaaaaaaagaaaaaagccctagcatgtagcaaaagcatttcttggtgagtgtgggggctggtgattcccaccttcaccctgtcatggtctcagggaacagcctgcttcccaccagcagcttgacacccacagtgtgctctggctgctgggagcccatctctcggagaaaccctgtccacccaaccccgagagccctagcgtgcagtcagcgtcagcacggcgctcccagatgagggccggactgcctccccttaagcagctgtgttggaggtactgcccagaccgctgcaggtccctggggatctgcatttctaac

SEQ ID NO: 12772 - DNA, 627 bp, Homo sapiens
ggcagaagaaagaaagaaacctcatcctatattttacaaagcatgtgaattctggcattagctctcataggagacccatgtgcttccttgctcagtgcaaaactgatgattctacttgctgtagatgaatggttaacacgagctagttaaacagtgccattgttttgccagtgaagcctccaaccctaagccactgggacggtggccggagatgccagcagcctctgtcgcccttagtcatataaccaaaatccagaccttatccacaacccggggcttggaaaggaaggtattttggaatcacaccctccggttatgttgctccagtaaaatcttgcctggaaagaggcagtcttcttagcatggtgagctgagttcatggcttttttttgtagccagtcctgtccctggccatccatgtgatggttttggatggagttaaacttgatgccagtgggcagtgcatgtggaaagtatcagagtaagcctctcccctccagagccctgagtttcttggctgcatgaaggttttctttagaatcagaattgtagccagtttctttggccagaaggatgaatacttggatattactgaaagggaggggtggagatgggtgtggcagtgta

SEQ ID NO: 12773 - DNA, 593 bp, Homo sapiens; identical to SEQ ID NO: 1602

SEQ ID NO: 12774 - DNA, 565 bp, Homo sapiens; identical to SEQ ID NO: 1607

SEQ ID NO: 12775 - DNA, 656 bp, Homo sapiens
tacggccgggtgcaatgcaattaaaacataataacggccagacgcggtcgctcacgcctttaatcccagcacttttggaggccgaggtgggtggatcactcgaggtcagaagttcgagaccaggctggccatcacggtgaaaccccatctctactaaaaatactaaaatcagctagtggcatggtggtgcacacctgcgcatggtggcacatgcctgttcctgctacttgggaggctgagtagctcagaccacaagtgcaccccaccatgtccggccaatttccgtattttatgtagagacagggtttcgatttacccacactggtctcaaactcctgggctcaagcgatcctctaacttcagcctcttgagtagctgggactctgagactgcaggagcaccaccacacctgctaacttttagaataaaagaaatttaaattgaatttttaggtcaaaaaatgagtaacagcttagatacaaagaggaatttgcgaattaaaacacagctttgaaaaaattgccctggccgggtgtggtggctcacgtctgtaatcttagcactttgggaggctgagacaggcagatcatgaggtcaggagttcaagaccagcctggctaacatggtgaaacccatctctgcaaaaaaaaaaaaaa

SEQ ID NO: 12776 - DNA, 520 bp, Homo sapiens
aatgctaaaacaggatttccagcccagatactttcccctagtgatgataatgacaatggtgatgaggatgatgatgataactggtagtagaagttggagaatgaaggaaagaaggagaagaaagatgaaaacaataataataacttagatttggagagtagtttacagtttttctaaatgctttctgggttgtagggaggcagggtgttgttctgaggaagagatggtctcaactaaattgttacttgcccaagatcacatatcggatcacatgagagccaaattctagctcatctgactccaaatttagtaactgttccattatacaatcttaaaaaaaaaggaaatggcacttggctttattaaaaatgtacaaataatgttacacttgcgatgagtaagctgcagactatctcagtctgcattatgataatatattctcagcactttttaacattttcttcaattgaattttattctcacactatcactcgcttcttttcctaacctcttttatttt

SEQ ID NO: 12777 - DNA, 509 bp, Homo sapiens
gggggtgtgcccactgagctgacagtggtggaggacgtgactgtgggcaggaggcaggcggtggcgtggctagtggccatgcacaaggctgccaagctcctctatgaatctcgggaccagtaattctacgtggggctgagcttggagtacgtgtggtcaccaggactgagtcgcttggaacagcagagcctgctccttgcgtaccacagggattaatcctgcttgtgctgggaaatgcaactcactcatgtatttggagaaacaggagtgttcacttatctagtgcaatatgttcacagtttgttaatgctttaaacagcttcatgttttagaatttgtgtattgtcaatacttaattggggtgggagagactgagctacactactgctaaactatttttagcataatatataccatttttatgagttcgcaggtctactagaaggttctggcccatcaatattcatttcatttaattcttccacagaaccagtttgggcagtaggaac

SEQ ID NO: 12778 - DNA, 530 bp, Homo sapiens
ctcctaatgacctccggcctagccatgtgatttcacttccactccataacgctcctcatactaggcctactaaccaacacactaaccatataccaatgatggcgcgatgtaacacgagaaagcacataccaaggccaccacacaccacctgtccaaaaaggccttcgatacgggataatcctatttattacctcagaagtttttttcttcgcaggatttttctgagccttttaccactccagcctagcccctaccccccaattaggagggcactggcccccaacaggcatcaccccgctaaatcccctagaagtcccactcctaaacacatccgtattactcgcatcaggagtatcaatcacctgagctcaccatagtctaatagaaaacaaccgaaaccaaataattcaagcactgcttattacaattttactgggtctctattttaccctcctacaagcctcagagtacttcgagtctcccttcaccatttccgacggcatctacggctcaacattttttgtagccac

SEQ ID NO: 12779 - DNA, 661 bp, Homo sapiens
tcggcacgaggcatgggagccgcgcgctctctcccggcgcccacacctgtctgagcggcgcagcgagccgcggcccgggcgggctgctcggcgcggaacagtgctcggcatggcagggattccagggctcctcttccttctcttctttctgctctgtgctgttgggcaagtgagcccttacagtgccccctggaaacccacttggcctgcataccgcctccctgtcggcttgccccagtctaccctcaatttatccaagccagactttggagccgaagccaaattagaagtatcttcttcatgtggaccccagtgtcataagggaactccactgcccacttacgaagaggccaagcaatatctgtcttatgaaacgctctatgccaatggcagccgcacagagacgcaggtgggcatctacatcctcagcagtagtggagatggggcccaacaccgagactcagggtcttcaggaaagtctcgaaggaagcggcagatttatggctatgacagcaggttcagcatttttgggaaggacttcctgctcaactaccctttctcaacatcagtgaagttatccacgggctgcaccggcaccctggtggcagaaaagcatgtcctcacagctgcccactgcatacacgatggaaaaacctatgtg

SEQ ID NO: 12780 - DNA, 405 bp, Homo sapiens
gaagctcttcatctacaacccgaccaccggagaattcctggggcgcaccgccaagaagctggggttggatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattac

SEQ ID NO: 12781 - DNA, 420 bp, Homo sapiens
ggtgcgtttgtggccgtccggcctccctgacatgcagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtggtgacggacctcaaagctgaaagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctga

SEQ ID NO: 12782 - DNA, 112 bp, Homo sapiens
tcaatatgcccctcttggcatatcatatttggaggcatatgaatagaccaatgatgaggggcccaggactctatgaccctacaaccatgatgaatgcagatattctagcata

SEQ ID NO: 12783 - DNA, 402 bp, Homo sapiens
  misc_feature 335: n = A,T,C or G
tcggcacgaggaaccgcaccttcgtcctcaacttcatcaagattcccgtggtcccgcacaatgagtgcagcgaggtcatgagcaacatggtgtctgagaacatgctgtgtgcgggcatcctcggggaccggcaggatgcctgcgagggcgacagtggggggcccatggtcgcctccttccacggcacctggttcctggtgggcctggtgagctggggtgagggctgtgggctccttcacaactacggcgtttacaccaaagtcagccgctacctcgactggatccatgggcacatcagagacaaggaagccccccagaagagctgggcaccttancgaccctccctgcagggctgggcttttgcatggcaatggatgggacattaaagggacatgtaacaag

SEQ ID NO: 12784 - DNA, 548 bp, Homo sapiens; identical to SEQ ID NO: 1626

SEQ ID NO: 12785 - DNA, 586 bp, Homo sapiens
ttcggcacgagaactggaagggttgtaggggggtgtgtggcccacccacattcctggccctggcaagtcagtcttaaaacaaggtttggaatgcacttctgtggaggcaccttgatatccccagagtgggtgttgactgctgcccactgcttggagaagtccccaaggccttcatcctacaaggtcatcctgggtgcacaccaagaagtgaatctcgaaccgcatgttcaggaaatagaagtgtctaggctgttcttggagcccacacgaaaagatattgccttgctaaagctaaccagtcctgccgtcatcactgacaaagtaatcccagcttgtctgccatccccaaattatgtggtcgctgaccggaccgaatgtttcatcactggctggggagaaacccaaggtacttttggagctggccttctcaaggaagcccagctccctgtgattgagaataaagtgtgcaatcgctatgagtttctgaatggaagagtccaatccaccgaactctgtgctgggcatttggccggaagcactgacagttgccaaggtgacagtggaggtcctctggtttgcttcgaga

SEQ ID NO: 12786 - DNA, 435 bp, Homo sapiens
tcggcacgagggggttgctggggccacgggtgctgtcctggagccgagagctgccttgcgcttggcgcgccctgcacacctccccggtctgcgccaagaaccgggcggcccgagtacgcgtaagcaagggggacaagccggtgacctacgaggaggcacacgcgccgcactacatcgcccaccgtaaaggctggctgtcgctgcacacaggtaacctggatggagaggaccatgccgcaaagcgaacggtggaggatgttttccttcgcaagttcatgtggggtaccttcccaggctgcctggctgaccagctggttttaaagcgccggggtaaccagttggagatctgtgccgtggtcctgaggcagttgtctccacacaagtactacttcctcgtgggctacagtgaaactttgctgtcctacttttacaaat

SEQ ID NO: 12787 - DNA, 605 bp, Homo sapiens
gctaaaattaaccctcactaaagggaataagcttgcggccgccatcccccggcgccatgcacccctggagcagctggttcgccagggctccttccgtgggttcccagcactcagccagaagaactcgcctttcaaacggcagctgagcctacggctgaatgagctgccatccacgctgcagcgccgcactgacttccaggtgaagggcacagtgcctgagatggagcctcctggtgccggcgacagtgacagcatcaacgctctgtgcacacagatcagttcatcttttgccagtgctggagcgccagcaccagggccaccacctgccacaacagggacttctgcctggggtgagccctccgtgccccctgcagctgccttccagcctgggcacaagcggacaccttcagaggctgagcgatggctggaggaggtgtcacaggtggccaaggcccagcagcagcagcagcagcaacagcaacagcagcagcagcagcagcagcaacagcagcaagcagcctcagtggccccagtgcccaccatgcctcctgccctgcagcctttccccgcccccgtggggccctttgacgctgcacctgcccaag

SEQ ID NO: 12788 - DNA, 116 bp, Homo sapiens
aaaatgaaatctatggttgcaccagataatagactatgtcctgattgtgattgacaatccaaccgaataagccactctcttggactacctgtgtcattccttaatttaatgccccc

SEQ ID NO: 12789 - DNA, 449 bp, Homo sapiens
cggtaggaaacgtctcgttgacagctcagagcttaaaaaaaatatatacacatatataaaaaacacttctgccccctcccccatgaacgggtccaggcagctccttcctgcagggggcagggggagagggccaccagggcagtgctcgttttcttgaaggcaccgaccctcctcctccccatgttccctgcctccagttccaatgcaggggtccaggtggcaggcccctctggaaggaatgggtcttccccaagcttccaccccaccttggattgggccgcagtgtggagggcctcatcaaactctttgggaccccccacccccactctccggtccattgtccatgccggaaccgcaagtgcagaagtgggtggggtgggccaggctggtccggtgctggcttagtctgatagttgctgtccctggaggaggacccccaagggctgatg

SEQ ID NO: 12790 - DNA, 577 bp, Homo sapiens
gggtctcctgccccagcgggccggctgcctaccctccagactgtccgctatggctccaaggctgttacccgccaccgtcgtgtgatgcactttcagcggcagaagctgatggctgtgactgaatatatccccccgaaaccagccatccacccatcatgcctgccatctcctcccagccccccacaggaggagataggcctcatcaggcttctccgccgggagatagcagcagttttccaggacaaccgaatgatagccgtctgccagaatgtggctctgagtgcagaggacaagcttcttatgcgacaccagctgcggaaacacaagatcctgatgaagatcttccccaaccaggtcctgaagcccttcctggaggattccaagtaccaaaatctgctgcccctttttgtggggcacaacatgctgctggtcagtgaagagcccaaggtcaaggagatggtacggatcttaaggactgtgccattcctgccgctgctaggtggctgcattgatgacaccatcctcagcaggcagggctttatcaactactccaagctccccagcctgcccctggtgc

SEQ ID NO: 12791 - DNA, 647 bp, Homo sapiens
  misc_feature 520: n = A,T,C or G
ttcggcacgagggaagatgaagagctgaccaacctgaactggctgcacgagagcaagaacttgctgaagagctttggggagtcggtcctcaggagtgtcatctcccgtgccaggtacctgggaagatgacacccccccatcccctgcccactctgacatgccctacgatgccaggcagaaccccaactgcaaacccccctactccttcagctgcctcatatttatggccatcgaggactctccaaccaagcgcctgccagtgaaggatatctacaactggatcttggaacattttccgtattttgcaaatgcacctactgggtggaaaaactcagtgagacacaatttatcattgaataagtgttttaagaaagtggacaaagagaggagtcacagtattgggaaagggtcgttgtggtgcatagacccagagtatagacaaaatctaattcaggctttgaaaaagacaccttatcacccacacccacacgtgttcaatacacctcccacctgtcctcangcatatcaaagcacatcaggtccacccatctggccgggcagtaccttcttcaagagaaatggagcccttctccaagatcctgacattgatgctgccagtgccatgatgcttttgaatactccccctg

SEQ ID NO: 12792 - DNA, 578 bp, Homo sapiens; identical to SEQ ID NO: 1636

SEQ ID NO: 12793 - DNA, 410 bp, Homo sapiens
catcgcctctgaggccctctgggggaaaagctccgtctccccgagcctggacacttgggccacatggctgtcctttgccaacgctgtctgccaccccctgatctatggactctggaacaagacacttcgcaaagaactactgggcatgtgctttggagaccggtattatcgggaaccatttgggcaacgacagacgacttccatgctcttcaacatttccaacaggatcacagacctgggcctgtccccacacctcactgcgctcatggcaggaggacagcccctggggcacaacaccagcacgggggacactggcttcagctgctcccacgactcacggacagatatgatgctgcttgaggactactcgtctgatgacaaccctgcctcttactgcacttgcccaccca

SEQ ID NO: 12794 - DNA, 504 bp, Homo sapiens
cggcacgaggaaaagctgggattacaggggtgagccaccgtgcccaacctcacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttaaactcgcctatcttaagtagtcatgctgtgcattttttttttcattg

SEQ ID NO: 12795 - DNA, 483 bp, Homo sapiens
ttcggcacgagggggccagctgccctctggctctggctgtggctcccgcctgtccggcagggcccagggccagcgtcgggcacagggcagctcccactggtctcggcaacacacccagccgcctggtacttcctccagcccctcccagtcagccctcccgtcctcggggcccctgcagccacccaacgtcacctccagcccggtctcacccatggtccagtctcccagcagcagcaacatccccacgcagccccccagcaagtcctctggcaagccggaggacgcagcccccaagaccagcggacagcgccagaaggaatcgtcgaaacagcctgccagcagcgcctcagtgcccgagctggtcccctgccattccgggacctctctggagtacacttcggagtccaccaccgagatcacctgcagctggccacaccacaggcccccgtgcctgcagcactactggtgcctgaaacacctggc

SEQ ID NO: 12796 - DNA, 140 bp, Homo sapiens; identical to SEQ ID NO: 979

SEQ ID NO: 12797 - DNA, 64 bp, Homo sapiens
tcggcacgaggctgaattgcggccgtatgcgcggctctgtggagtgcacctggggttgggggca

SEQ ID NO: 12798 - DNA, 611 bp, Homo sapiens
acagaggggcttttggctctctgaccagcaccatggcggttggcaagaacaagcgccttacgaaaggcggcaaaaagggagccaagaagaaagtggttgatccattttctaagaaagattggtatgatgtgaaagcacctgctaagttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcatt

SEQ ID NO: 12799 - DNA, 543 bp, Homo sapiens
acaaccagattgaaacaatggaggatctttgtgtggcaaacacactctttgccctcaatttattcaagcatctggcaaaagcaagccccacccagaacctcttcctctccccatggagcatctcgtccaccatggccatggtctacatgggctccaggggcagcaccgaagaccagatggccaaggtgcttcagtttaatgaagtgggagccaatgcagttacccccatgactccagagaactttaccagctgtgggttcatgcagcagatccagaagggtagttatcctgatgcgattttgcaggcacaagctgcagataaaatccattcatccttccgctctctcagctctgcaatcaatgcatccacagggaattatttactggaaagtgtcaataagctgtttggtgagaagtctgcgagcttccgggaagaatatattcgactctgtcagaaatattactcctcagaaccccaggcagtagacttcctagaatgtgcagaagaagctagaaaaaagattaattcctgggtcaagactc

SEQ ID NO: 12800 - DNA, 567 bp, Homo sapiens
cggcaccctgcttcaacagtgcttggacggaacccggcgctcgttccccaccccggccggccgcccatagccagccctccgtcacctcttcaccgcaccctcggactgccccaaggcccccgccgccgctccagcgccgcgcaaccaccgccgccgccgccgcctctccttaatcgccgccatgacgaccgcgtccacctcgcaggtgcgccagaactaccaccaggactcagaggccgccatcaaccgccagatcaacctggagctctacgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggccgaatcttccttcaagatatcaagaaaccagactgtgatgactgggacagcgggctgaatgcaatggagtgtgcattacatttggaaaaaaatgtgaatcagtcactactggaactgcacaaactggccactgacaaaaatgaccccca

SEQ ID NO: 12801 - DNA, 553 bp, Homo sapiens
actagtggatcccccgggctgcaggaattcggcacgagggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctg

SEQ ID NO: 12802 - DNA, 495 bp, Homo sapiens
  misc_feature 45: n = A,T,C or G
ttcggcacgagcagcccgctgaggagctttcttgggctgcccccnatctctcccaacaaggtgtacatattctgcgtagatgctagaccaaccagcttcccagggttcgtcgctgtgaggcgtaagggacatgaattctagggtctcctttctccttatttattcttgtggctacatcatccctggctgtggatagtgcttttgtgtagcaaatgctccctccttaaggttatagggctccctgagtttgggagtgtggaagtactacttaactgtctgtcctgcttggctgtcgttatcgttttctggtgatgttgtgctaacaataagcagtacacgggtttatttctgtggcctgagaaggaagggacctccacgacaggtgggctgggtgcgatcgccggctgtttggcatgttcccaccgggagtgccgggcaggagcatggggtgcttggttgtttccttcctaataaaataaacgcgggtcgccatgc

SEQ ID NO: 12803 - DNA, 501 bp, Homo sapiens
tcggcacgaggataataagtaataaactggaacttatagcataattaccaggatagtgggagaaatctgaaaccatatcatatggaaaatggtgaaggctctagtaatatttattgcatgctgttgacaccaatttaaaagttatctttaaatacttgaagagttatgtaaagattagatttttgactcaatatacaacaaattgtaaattctattacaaaaatagaatatactgtcttataagtcctcttctattaatattattattaaaacagaactaaatggaagggtggtaattaataaagattcaagctaacgtatggggcccggcatgttggctcatgcctgtaatcccagcctgaccaacatgaggttgaagcgggcagatcacttgaggtcacgagtttgagaccagcctgaccaacatggtgaaatcccatctctactaaaaatacaaaattagctgggcatggtggtgcacgcccataatcccagctactc

SEQ ID NO: 12804 - DNA, 658 bp, Homo sapiens
  misc_feature 506, 599: n = A,T,C or G
cggcacgaggctgaccaggccctgggcctcagcgaccacccctccccctcctgcctggacccagggagcaggtgcagggggctccgagcccctggtgactgtcaccgtgcagtgcgccttcacagtggccctgagggcacgaagaggagccgacctgtccagcctgcgggcactgctgggccaagccctccctcaccaggcccagcttgggcaactcaggtgggccagaaagcccccggtggctgcggtggagctgggcaccgccccgactgaggcagctgctggaagagggggtggcagaggtcactgccctccctgcaggccccacccaggaggccccctctgaggaatctctttgcagttacctagccccaggtgaggacgggcactgggtccccatccccgaggaggagtcgctgcagaaggcctggcaggacgcagctgcctgccccagggggctgcagctgcagtgcaggggagccgggggtcggccggtcctctaccangtggtggcccagcacagctactccgcccaggggccagaagacctgggcttccgacagggggacacggtggacgtcctgtgtgaagtggaccangcatggctggagggccactgtgacggccgcatcggcatcttccccaagtgcttcgtggt

SEQ ID NO: 12805 - DNA, 258 bp, Homo sapiens
atgtaacccctgggccctggcttaaaccgacactcctgacctctgtgttcaccctgagggctgacttgaagcccgctacccactctgaggctcctaagaggtaccatgcttgccactctggggcctgcccctgcctaacagtctcccagctcccaacagcctggggaagctctgcacagagtgacctgagaccaggtacaggaaacctgtagctcaatcagtgtctctataactgcataagcaataagatcttaataa

SEQ ID NO: 12806 - DNA, 350 bp, Homo sapiens
gagaagacgacagaagggctacatatttgttaggcactttacctatgatatttgcttttcagaattctgggaaattgtaattataagccccattttatagaaaaaggaaccaaagctagaaatgcaggaccaaaatttgaacccaggtgagcctgagctcaccaatcctaagcttctccacactgcacgcttgaacctctggaaagaacacgaggcacacctccctatcattccactccaagaaaaggagttctgaacaagccacggctcaactggatcacaattccagagggaggagttttcaatggaaggtaaaaaaaaaaaaaaaaaaaaaaaaaaagtcgtatcga

SEQ ID NO: 12807 - DNA, 278 bp, Homo sapiens
gagaagacgacagaaggggttcaacatcacttgggtctggggtggctcctcatcagcacacagagacccataaggccagataagaggctgtctctctaactagtactttaggagggcagccacaaagatgatggcttctggcatctttcatggagacaggccagcaccacggtaacttgatgagacatactcctgtcacacctaataaatttgccagcctgtcatcctcttctctttcaaaaaaaaaaaaaaaaaaaaaaaaaaaaagtcgtatcgat

SEQ ID NO: 12808 - DNA, 481 bp, Homo sapiens
tcgcgcgcctgcagggtcgacactagtggatccaaagaattcggcacgagcaggccttgctcaccaccataagcacaggggtcaacataggcagggtcacccaaagaaccgagatatgccagcaagtgaagatttacaagatttacaaaagaagctctgtcgaaagagatgtataaatcacttactctgtaaattgcccacagattcatagttggctcctatgagctgatgctgccattggcgacatctgatatttgaaaaaacagggtctgcactcacctgacagtgtaaagaaaacctcccatctttatgtagctgacagggacttcgggcagaggagaacataactgaatcttgtcagtgacgtttgcctccagctgcctgacaaataagtcagcagcttatacccacagaagccagtgccagttgacgctgagagaatcaggcaaaaaagtgagaatgaccttcaaactaaatattt

SEQ ID NO: 12809 - DNA, 98 bp, Homo sapiens
ttttggctctactttgcagggaatctggcatcgggtggtgccgcaggggccacatccctgtgttttgtgtaccctcttgattttgcccgtacccgtct

SEQ ID NO: 12810 - DNA, 319 bp, Homo sapiens
ttcggcacgaggcttttttttttttttttttcccccccccacctttttgggaatagttaaaaatacctttttttttttcaaggactcaaggggcttttcccttcggcttttaaaaaccggtttccggcaaaggaaccccggtggtttaggggatttagtttccaaaaataccttttggtttttgggaaaaaggctttttttggaattcccggaaaacccccaaattatgcaacctcggaccttggaggttacctcggggtttaaaattaagccttgaaaaaaaaggggtttaaacccttggccatccccttttttgggc

SEQ ID NO: 12811 - DNA, 644 bp, Homo sapiens
gatttttttttcaattttatttgagccaaaatatatatacttaattttagttatgccagaagtaagtataatttctcagtccaaggatgttaggaagcaacttacagagcatgcttcaaatagaattctcttggcctttgaaggtaactattttcaaacttaatagtagagtcaagcaagaatggacaattagagttttcaaaattgaaaaatattatgtattttatataatcattacctatggtttacagattttatttttatgatacatatctctaagtagtggtacactgaggacatagcaaatatgcaataaatacttattaagctgaagtgaactaacaaaaaccattaattacaccatttctaacaaccaaaccagctattgcttttcagtgttttggtgatacgttggagtaggaagtcatattcaaattggttagatccttggaagaaatagtagtatttgtttttagagtagaagactgcatcaattttaggcccgattccttggaagttcttggtaatcagtttgggataacagggtccatcatctgtctcctttcatcatacctccaatactggttatctacaaagaagtagggtctataaaaacgtgggttaaaaacagctgcatcaatttt

SEQ ID NO: 12812 - DNA, 658 bp, Homo sapiens
  misc_feature 536: n = A,T,C or G
catgccacttctgtggtggctccctcatcaacgaacagtgggtggtatcagcaggccactgctacaagtcccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcgccgactacccagacgagctgcagtgcctggatgctcctgtgctgagccaggctaagtgtgaagcctcctaccctggaaagattaccagcaacatgttctgtgtgggcttccttgagggaggcaaggattcatgtcagggtgattctggtggccctgtggtctgcaatggacagctccaaggagttgtctcctggggtgatggctgtgcccanaagaacaagcctggagtctacaccaaggtctacaactatgtgaaatggattaagaacaccatagctgccaatagctaaagcccccagtatctcttcagtctctataccaataaagtgaccct

SEQ ID NO: 12813 - DNA, 418 bp, Homo sapiens
  misc_feature 136, 379, 400, 412: n = A,T,C or G
gcgaaaaattacgaagagattgcaaaagttgagaagctcaaaccattagaggtagagctgcgacgcctagaagacctttcagaatctattgttaatgattttgcctacatgaagaagagagaagaggagatgcgtnataccaacgagtcaacaaacactcgggtcctatacttcagcatcttttcaatgttttgtctcattggactagctacctggcaggtcttctacctgcgacgcttcttcaaggccaagaaattgattgagtaatgaatgaggcatattctcctcccaccttgtacctcagccagcagaacatcgctgggacgtgcctggcctaaggcattcctaccaacagcaccattcaaggcacgttgggagntttcttgccagaactggattntcttttggtgtngggagg

SEQ ID NO: 12814 - DNA, 474 bp, Homo sapiens; identical to SEQ ID NO: 1684

SEQ ID NO: 12815 - DNA, 153 bp, Homo sapiens
tcggcacgagggcctgtaatcccagctaaccatgagctgaggcaagacaatcacttgggcccgggaggcaaggttgcactgagccgaaccatgccactgactccggcctgggtgacaggcaagacttgtctcaaaaaaaaaaaaaaaattccc

SEQ ID NO: 12816 - DNA, 507 bp, Homo sapiens
ttcggcacgaggctgaagtgggttggccaggaggttcccccgaccggttggggagacttggggccagcgcttctggtctggtaaatatgtatgatgtgttgtgcttttttaaccaaggaggggccagtggattcccacagcacaaccggtcccttccatgccctgggatgcctcaccacacccaggtctcttcctttgctctgaggtcccttcaaggcctccccaatccaggccaaagccccatgtgccttgtccaggaactgcctgggccatgcgaggggccagcagagggcgccaccaccacctgacggctggggacccacccagcccctctcccctctctgctccagactcacttgccattgccaggagatggccccaacaagcaccccgcttttgcagcagaggagctgagttggcagaccgggcccccctgaaccgcaccccatcccaccagccccggccttgctttgtctggcctcacgtgtctcaaattttctaagaacc

SEQ ID NO: 12817 - DNA, 535 bp, Homo sapiens
tcggcacgaggcctcgtgccgagctgggctctactcctgagtgagtctagtgggcttgggggtgtccatgtggtgctgtcccttggcagggtcagggcagctgctagggtgggaccagcagttggggtctgcagcgtggagatgggcaggaagctggagcccggctcatcgtcgcatagcctgcctgcacccgccccccgccaccacctcctggtgggttccgccctcatgccccacctctccctgcagcgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcaaaagggggttttaggggcctgggctggggggatggggagggcacatcgtgactgtgtttttcataacttatgtttttatatggttgcatttacgccaataaatcctcagctggg

SEQ ID NO: 12818 - DNA, 459 bp, Homo sapiens
tcggcacgaggtgtgggtaaaatttgaaaattgaatttataataacaattctacattttaaaccctattgccactttatgcatcctcaatgaaatggactgaaggctaatatgcttgctttatttacttttgtaatcttggattttgtaacttttaaaactagaaaccattggtctaacaaatcatgcaactgtattctataaacacaactttattaagcagaatacactgtagatgcttttccccaacatatctggctggcagtctttgtcgttgttcattctggggataaaggggaactacgctagcaattctaatgtgacattctttaagcatatcttaaaatagtatttaagtaaatggtctaatttctacataattattgcactgaacttttttgtttattaaggtgtttaaataagctcagctaattcaatacactgtactcacttgtgcatc

SEQ ID NO: 12819 - DNA, 545 bp, Homo sapiens
tcggcacgaggcaatttcagagataccaccagggattgggctgcttactagacttcaggaactgattctcagctacaacaaaatcaagactgtccccaaggaactaagtaattgtgccagcttggagaaactagaactggctgttaacagagatatatgtgatcttccacaagagctcagcaatctgctaaaacttactcaccttgatctgagtatgaacgattttactacaatccctcttgctgtgttgaacatgcctgcccttgagtggctggacatgggaagcaacaaacttgaacaacttcctgatactatagaaagaatgcaaaatctacatacgttatggctgcaacgaaatgaaataacatgcttgcctcaaacaatcagcaatatgaaaaatctgggtactcttgttctcagcaacaataaactgcaagatattccagtatgcatggaagaaatggcaaatctgaggtttgtcaacttcagagacaacccactgaaattgaaagtatcacttcctcccagtgaaggcacagatgaag

SEQ ID NO: 12820 - DNA, 118 bp, Homo sapiens; identical to SEQ ID NO: 275

SEQ ID NO: 12821 - DNA, 197 bp, Homo sapiens
gaagctggtacgcctgcaggtaccggtccggaattcccgggtcgacatcatcatcatgatcgctcgacatcgatacgacttttttttttttttttttttttttggggggaaaaggggaacccctttttttttttggggggcccaatttaaccggggggccaaaaaaaaatttttttttaaaaccccggggggggggg

SEQ ID NO: 12822 - DNA, 140 bp, Homo sapiens
attcggcacgaggtaaaacctgaggagaaggagaccacagagaatgtacaacagacagtgagtgctaaaggcccccctgaaaaacggatgagacttgagtgagtactggacaaaagataagcctggaagactcctcatgc

SEQ ID NO: 12823 - DNA, 413 bp, Homo sapiens
attcggcacgagccctgggtctaggaatcctggctctacagcatgacttggtgatcctgtgcaagtcttttaacctctccacaccagggctgcgctggtccagcaggattccctatcagggagaggggacttactaaaaccatctggagagcatgtctgcaaactacagtgggccagcctctgcccagagagcctgaagttgctcacttgcaaggaagaggtgcagagcattgcaatctgctaccacacctctcacacctggtgagaatcagttctgatctccaaggttctgacctctgagagtgacgttaagtccagagagccacaccactacaccctgagagaccttcagcaaaaggcccgtgagctcaaagaaattggggtcaggatgcttttaaagcaaaaaatgcttt

SEQ ID NO: 12824 - DNA, 588 bp, Homo sapiens
tgaacaactgatcgaagctatcaacaatggggactttgaagcctacacaaaaatctgtgacccaggccttactgcttttgaacctgaagctttgggtaatttagtggaagggatggattttcaccgattctactttgaaaatgctttgtccaaaagcaataaaccaatccacactattattctaaaccctcatgtacatctggtaggggatgatgccgcctgcatagcatatattaggctcacacagtacatggatggcagtggaatgccaaagacaatgcagtcagaagagactcgtgtgtggcaccgccgggatggaaagtgggagaatgttcattttcatcgctcggggtcaccaacagtacccatcaagtaaatatttccaggctgtcagcttctttgttaatacacccatgctaaatttcaacagtgccgcatctgcattctctgttctcaaggcacctggatggtgaccctgggccgtcctctcctcctcttcatgcatgtttctgagtgcatgaagttgtgaaggtcctacatgtaatgcatatgtgatgcatcatcttatcatatattccttcctataca

SEQ ID NO: 12825 - DNA, 441 bp, Homo sapiens
tttgtttttagatatttttcctataggtttctgctgtggagccgtactcactgcagaccctgaaggaggaggagcacctgctttctgccactcagtgcgctcagctgccattcttctcacatatgcatcatccacacacatcaagatattttccggctttatgtcagtatgaatgatcttgcacttactgtgtaagtaatctaacccttgaaggacctgtcgaatgatactcttcacacaacgtactgggaggccttgatagttggatttgatgatccacttgaggagatggtggccaagtacttcgaagaccatgcagacatgtatcccattcatgcctgaaatcttgaagtcgtcaatgagctggaccaccatgtctttgtttgggtcactgggatcactttctcgaacacatttgagcaattttatttcatcaaggct

SEQ ID NO: 12826 - DNA, 603 bp, Homo sapiens
tggatcccccgggctgcaggaattcggcacgagctgtacacttttcctgggtggtctcatccattcctttgctttttcataccatttatttgttaatgattcccacatttatttatgcacttggagagctcacaggaatctcagaaactgatgaggtacaattctgaaccctcagtctcttccctttaaacctttctttttctctactttaatttttctaaagagtgtcttgctatgttgcccaggctggtctccaactcaagtgatcctcctgccgcagtctcccgaagtgctgggattactgacatgagccaccacactcagccctttaaacctttccctggcctttcccatagctggtgaaggacacctccatccattccacccagttgctcaaagcagaaattttcagtgcaagtcttgatgctgcgccgtcccccactccctacatcagaacgcatccctcatctggactccagcggtggcttcttgatgctgcgcggtcccccactccctacatcagaatgcatcccgcatccagactccagcggtggcgctctacctgcacgctgttgccaagtccaagctaccatactcctgcct

SEQ ID NO: 12827 - DNA, 266 bp, Homo sapiens; identical to SEQ ID NO: 1716

SEQ ID NO: 12828 - DNA, 415 bp, Homo sapiens; identical to SEQ ID NO: 6453
  misc_feature 2, 4, 112, 237, 270, 370, 407: n = A,T,C or G

SEQ ID NO: 12829 - DNA, 543 bp, Homo sapiens; identical to SEQ ID NO: 1722
  misc_feature 465: n = A,T,C or G

SEQ ID NO: 12830 - DNA, 299 bp, Homo sapiens
caagactgcgggaaaccccccctaaactgacacctgcccttcctagaattggaaggcacctatgaggaaaatgagcgggcactggagagtaaggcagcccacttggacgggttggaggccaggatgcgcagcgtgcttcaagccatcaacttgcaggtgcagatctacaacacctgccagtgacccctgcccaaggcctaccccagttcctagcactgccccacatgcatgtctgcctatgcactgaagagctcttggcccggcagggcccccaataaaccagtgtgaacccccaaaag

SEQ ID NO: 12831 - DNA, 532 bp, Homo sapiens
tcggcacgagggacaaacaaaactcacaaatgaatgcttctcacccggaaacaaacttgccagttgggtatcctcctcagtatccaccgacagcattccaaggacctccaggatatagtggctaccctgggccccaggtcagctacccacccccaccagccggccattcaggtcctggcccagctggctttcctgtcccaaatcagccagtgtataatcagccagtatataatcagccagttggagctgcaggggtaccatggatgccagcgccacagcctccattaaactgtccacctggattagaatatttaagtcagatagatcagatactgattcatcagcaaattgaacttctggaagttttaacaggttttgaaactaataacaaatatgaaattaagaacagctttggacagagggtttactttgcagcggaagatactgattgctgtacccgaaattgctgtgggccatctagaccttttaccttgaggattattgataatatgggtcaagaagtcataactct

SEQ ID NO: 12832 - DNA, 648 bp, Homo sapiens
  misc_feature 203, 357: n = A,T,C or G
tcggcacgaggccggttgctctcaacatggtcctacctgatgagaagggtgcgggggcccttcccttcctaccaggggtctttggctacgcagtgaatcctcaagcagcaccccctgccccaccaacaccacctcccccaactcttcctccaccaattccccctaagggagaaggggaaagggcaggggttgagagaacccanaagggcgatgtggggtgaaccctggggctcaatccccctttcaccagatgccaccctccctgaaccccccaccactaccagctccctggcctccctgccccttgggagccccttcacactcttgtgcagggacttgggggcccctggagctcangggtcaggctgctttgtgtgagatgtagttttcccatctcctgggaagggatctttcgaggttcccctctcagtcttcctccagggaatggcctccatgaggggcagggccagcttccatcccttctccagcccttggggcaactgagcaatatacttaacctgaatctctactcacagcccccaccagctctgaatgtctaacctgctcccctgattcgtaaacctaagggaaaccatctctctcacctaatgacccgccttgttctgaagctttctctaagcccttccc

SEQ ID NO: 12833 - DNA, 534 bp, Homo sapiens
  misc_feature 379, 433: n = A,T,C or G
tcggcacgaggggatatccttcacttcaaaaagcttcataaagtcaggtccttctgtacctcccttagtgaatccacctctgcctacaacttttcaaccaggagctcctcatgggccccctccagctggaggcccacccccagtgagggccctcacgcccctgacatcatcatatagagatgtaccccagcccttatttaattcagctgtcaaccaagaaggtaagtgaaccaagaaacaaagtcaaatcctcaagttttgacttagggtagaaagatgaatattagctgaattctgtgcattaaaatcacattttttccagaaaatctagttttggttagggatgggctacaggaatttacaatttaaagttcctcangaattccattgccatccgctgggctgtgactaccattgggaaaaaagctcttantgttttgttactttttttgttgctatgcggattttttaaaaatcatggctataaagtcaggtggcttttggaggagaattactacttttcttgacatgatg

SEQ ID NO: 12834 - DNA, 611 bp, Homo sapiens
  misc_feature 418: n = A,T,C or G
tcggcacgaggagtacagctttatggcggtcatccactttgcggggctcaaggccgtgggcgagtcggtgcagaagcctctggattattacagagttaacctgaccgggaccatccagcttctggagatcatgaaggcccacggggtgaagaacctggtgttcagcagctcagccactgtgtacgggaacccccagtacctgccccttgatgaggcccaccccacgggtggttgtaccaacccttacggcaagtccaagttcttcatcgaggaaatgatccgggacctgtgccaggcagacaagacttggaacgcagtgctgctgcgctatttcaaccccacaggtgcccatgcctctggctgcattggtgaggatccccagggcatacccaacaacctcatgccttatgtctcccangtggcgatcgggcgacgggaggccctgaatgtctttggcaatgactatgacacagaggatggcacaggtgtccgggattacatccatgtcgtggatctggccaagggccacattgcagccttaaggaagctgaaagaacagtgtggctgccggatctacaacctgggcacgggcacaggctattcagtgctgc

SEQ ID NO: 12835 - DNA, 563 bp, Homo sapiens
catgtgaagacatcaatgagtgcagcagcagcccctgtagccaggagtgtgccaacgtctacggctcctaccagtgttactgccggcgaggctaccagctcagcgatgtggatggagtcacctgtgaagacatcgacgagtgcgccctgcccaccgggggccacatctgctcctaccgctgcatcaacatccctggaagcttccagtgcagctgcccctcgtctggctacaggctggcccccaatggccgcaactgccaagacattgatgagtgtgtgactggcatccacaactgctccatcaacgagacctgcttcaacatccagggcggcttccgctgcctggccttcgagtgccctgagaactaccgccgctccgcagccacgctccagcaggagaagacagacacggtccgctgcatcaagtcctgccgccccaacgatgtcacatgcgtgttcgaccccgtgcacaccatctcccacaccgtcatctcgctgcctaccttccgcgagttcacccgccctgaagagatcatcttcctccgggccatcacgccaccgcat

SEQ ID NO: 12836 - DNA, 491 bp, Homo sapiens
aactaactttatttctctggaagaagcaggtactgaatgccggagcagcaacttcgccaacaggctggtgggaaaacatggaaccgcgtgggggaattgggtggaagaagaagcactgatgtccctccagggcggctgccccttggtctccttccagccctggggccttgggccctggtccccgccagagaatggtctggcaccctttctccgcttcctgagccacctcaggctatttccaggcacaagatcctgaggccagccaagtcccattcaagtccatggtaaggccacaagtcacattctgcccgacaccccagctgctgccaggggccccctggaagaaggcccagtcctaggaggtcccaccgggtgccggtccgcctctccctgtggccaacacatcccgcctgcccaggtccagcctggtttcctcccagtctgtcacccagggcagggcctgggggtactactccacccacaggccccgc

SEQ ID NO: 12837 - DNA, 522 bp, Homo sapiens
gcggccgcgttcccggtgctccagcacctggccgcctccgccgacttctgcagcctcgatacaaagctctctacgtcgtcgaacacgtggttcaggatgtccacttcccgctccgcctgcagaaccgccagtcaaggaccccggggacccaggtccggggaggccgagtcagcgttgctcgaggtccccaccggctcaggcctctgcgcctcctctgcctcgggaatgggcttcgctggggtcgtccgcggcccggccccgctctacggtgctgatcactgcgcggactgacgggcggcgctgcaggggcggggtctcagcggcgggcgagcggtcgcgctgcaactcctcctgcgtggccctgagcgccgccgccctgcgctccccgcggcccgagcggtaattgtgcagagccccctggatgtcctctcggatcagctccgccccgagggccaggacctggaagaagtgcacgtcgtgctgcgcgcgctcgggttcctggcacacgagcagcagcaacga

SEQ ID NO: 12838 - DNA, 544 bp, Homo sapiens
  misc_feature 80: n = A,T,C or G
ttcggcacgaggcgcccgctgagacccggagcccgcgtccgcatccaacaggaagggaagaaacacattctggtgcttancgagctgcgcgccgaggacgccggtgaagtccgcttccaggcggggcccgcccagtccctggctctactggaagtggaggcattgcctctccagatgtgccgccacccccctcgcgagaagaccgttctggtgggccgccgggcggtgctggaggtgactgtgtcccgctcggggggccacgtgtgctggctgcgggagggggccgagctgtgcccgggagataagtatgagatgcgcagccacggccccacccacagcctggtcatccatgacgttcgacctgaggaccaaggcacttactgctgccaggccggccaggacagcacccacacacggctgctggtagagggcaactaggagaacctaaccaggccaggcgggtgcccttggacagcttggaaggcgtttgcccttaccctgggcaggggtagagagacaaggaacaataaaagtgctacagctc

SEQ ID NO: 12839 - DNA, 493 bp, Homo sapiens
tcggcacgaggcaaactgtagatggtagctaatttttctttacctattttctaatgtcatgattcctgtttgcccaatggatcatttgtatgttaaccactgtatgtaaccaacccttatctggcaacataattgcagcacaataatgatttgcatgataccttgaaattggggggagggggcatgccaagttgggcatcactttgtcttaacaattaatgggatattgattactaaaataagttaatattaagcaaggtgccggttgtacaatctctgatcagtgtcttttcagcactttgagcatttacttggctcatttagtcttccttttgtagcgcatggttgggaggaaaaagtgcatgcatcattccttcactcttctctttttcccgcccccccctcccttcgcacataggcatttggtttgcttccatctttttttatgcagtgcctgtttttttttaaccaattaaaatcccttttgttgatg

SEQ ID NO: 12840 - DNA, 497 bp, Homo sapiens
  misc_feature 353: n = A,T,C or G
caaaagtgttgttttttattttctttcttgggccagctgcagcttccaaccaagaaaacctcaaagcattagggaaggagcaggtgtggggctggggtggggagaatccctcaagctccagggcccagggtctaacctgagaggtcggggctgcaggaagctgggggaggctcccggggctgggggaagaggagcctgcccccagcagaaacagcaggtctcagcggctacatgtgctttagagcttggctctctctgagcagatgggacaggaagacgggcactggggggctgggtggggcttagcgcaggtcctcctcatcgccctggatggtcttcttgatgcgcaagcnattggtggtgagccactggtccagccgggagatggagtcgtattccttcaccgactcggtgtagctgtccacattctgctcctcgtgggcctctagcaattttttcatcaacttgcattcccgggaatcagagaaagctgggaa

SEQ ID NO: 12841 - DNA, 617 bp, Homo sapiens
gagctgggaaagcacttgtctcctttattgaacatctgcagggggcacctctgcactgaccaggcagccaaaaaagcaagcaggcaggtgggggggggcaggggagcatggggcaggaagacccccaccctcatttccagtccttgaaaaattgcttgaagatgggactctcacggccctgaggcaaaatctccacctgagtgttcggggcgtactgcatgcgcgagatgaagccctcggccacctgcagggctgcctgccgctccttctcattcgcttttcgccccttccagatatagatcttgccacagagcccgttgtccagcacaaagcagtcatcaaatatcagcagttcaagggcaaaggggctggagtcagccaccttggtcagggtcatctggtccagtggcatcaaagaccttatacagagctgcggcctgggcatttgccttgtcagctgtgaggtcttcctcagggttgccctccttcagagcaggcttggggcccaggacctggatcatctcagcaggctcctccccatcagtgacaatctccacctgggccttgccctgtcgctcactgtcccggatggccagggccaggtccctcgccttgtg

SEQ ID NO: 12842 - DNA, 738 bp, Homo sapiens
  misc_feature 539, 604, 618, 651: n = A,T,C or G
gcgactttgaaagattgtaatatatgctctggaaaacattcagcagtacgaaagccctccctgggccctcccaccctctcatggtccacaactggtagaaaggtccagaaatccttgagctctggaaaggtccctggtcagtccttggggagctcagatagctatattggaagaacctgctcaagtacggttcttgatgtctggggaatcctttcggggaagatcacttcaaactcaataatgaggtccccacgtttctcgggtgttttggggagggggaggccttctccaggaacttttcgccgcatgccaggcctgataacatctttgaatacgacgggtatcgtcctgccgtccagagtggggacgttcactgtgcagccacacagagcctcccggaggctgatcctggcaggataaatgacatcagagccatctctcttaaagatattgtggggcttgtcctttaaaacaaagacgatatcagctggaatgttgttggaggtctggtctccttccttggggaaagtgattttggntcctttcttccacccctttctcacttcgatggtcaatattttgtcttcgtttcgaatgctctttncgtcggggtttagnccgcttgtggagattttcatcttcctggtacangccgctgtagatctctttcagggagaactcgaaggtcgtgggtgaccttggggattcttgcttcttttcggcccggcctcttgggca

SEQ ID NO: 12843 - DNA, 699 bp, Homo sapiens
  misc_feature 536, 596, 614, 633, 694: n = A,T,C or G
tttaaatttttgggaatttattgatttgcatttaaaagggaactgctgacaaagattcactggtaataatttgaacaagttggaaaatacagtcaacattactgaaacactactaaaataattccaggacagaacaaaacttcttagatgctgtctttgatgtgaaaattgactgcttcttacttttctaacacacggtggtataattaacaatattcaatcacttctattctttcctgcatatataaaaattaaaataccaattaaaaaactaatatatcttctctttatttcttacagatatgagttcaatgtttcactcaatagtgctgtggtttaagagaattttttcatttacaagttaaacaacaatccgcccaaagggaactgatagtctataggctcatagtgcaaataaacagtttaggaatgcagcaactgacatttctaaagtacaaaacagataaaattcttagaagatacatgcaaaaagctctactaagcagatggccacagaactagaacattgataattntactggcgatgtcaataggactccagatgtttccaaactcaacttgaactctcatcttangctttgtatttgcttttncagttcactaatgacacanacatgattcaaatcccctgagtattcattatagtcaagggcatatcctacaacaaactggnctgga

SEQ ID NO: 12844 - DNA, 90 bp, Homo sapiens
cccaccaccctggggcccaaaaaaacctaaccctttaagggggttgggccctgaagaaccctttttttgcccacccccccaaaggggggg

SEQ ID NO: 12845 - DNA, 467 bp, Homo sapiens; identical to SEQ ID NO: 1762

SEQ ID NO: 12846 - DNA, 476 bp, Homo sapiens
tgctggcccagggccacaccaagccacccgagcgcagtgccacaggcgccaagagcaagtacctcatcttcaccactggctgcctcacctactccccacaccagatcggcatcaagcagatcctgccacaccagatgaccacggcagggcccgtgctgggtgagggccggggctccgatgccttcttcgacgcgctggaccacgtcatagacatacacggacacatcatcggcatgggcctgtcgcccgacaacaggtacctgtacgtgaacagccgcgcctggcccaacggtgcggtggtggccgaccccatgcagccgccaccaatcgcggaggagattgacctgctggtgttcgacctcaaaaccatgcgggaggtgaggcgggctctgcgtgcgcaccgcgcctacacgcccaacgacgagtgcttcttcatcttcctggacgtcagcagggacttcgtggccagcggggcg

SEQ ID NO: 12847 - DNA, 482 bp, Homo sapiens; identical to SEQ ID NO: 1766

SEQ ID NO: 12848 - DNA, 778 bp, Homo sapiens
  misc_feature 4, 556, 562, 581, 651, 659, 671, 681, 688, 697, 709, 720,731, 764: n = A,T,C or G
gcgnccgctgcccgccttaatcgactgaagaagaaggagtacgtgatggggctggagagtcgagtccggggtctggcagccgagaaccaggagctgcgggccgagaatcgggagctgggcaaacgcgtacaggcactgcaggaggagagtcgctacctacgggcagtcttagccaacgagactggactggctcgcttgctgagccggctgagcggcgtgggactgcggctgaccacctcgctcttcagagactcgcccgccggtgaccacgactacgctctgccagtgggaaagcagaagcaggacctgctggaagaggacgactcggcgggaggagtctgtctccatgtggacaaggataaggtgtcggtggagttctgctcggcgtgcgcccggaagcgtcgtcttctcttaaaatgtagggtcaagtaatctgctctttatccgcgtttaccctttcaactcccttacaccatgtcaaattacttagtgggacatttcaccggacacatttcagaggagagaaaaaaagtaatattgaacttaaagtgtttantaaaancatgaatgtgacacagtanccactcctaatgataacatgtgactattaaaccctctgacagttctttttaagggattcctcctccagcnccgtgtanggttaagaaaangttccggctnaaactgnggaaaactntttggcaaaaanaggccaatttngccaattccgnttttttaaagggtttaaaaaaaaaatcccggcnaatttgggggggga

SEQ ID NO: 12849 - DNA, 525 bp, Homo sapiens
  misc_feature 407: n = A,T,C or G
tcggcacgagtttttgtatttttagtagagacacgggtttcatcatgttggccaggatggtctctatctcttgatctcatgatctgcccggctcggcctcctgaagtgctgggatttcaggtgtgagccaccgcgcccagcctaacctttttaaaaaaagtggttgttcatgcttaagaaatgagtttcagaactttgaaaaaaaaattccaggaatatagatcgcaaaattagaaaatactcttttgattcttttcattagaattatttgcttgatttcctctataaatttccgtaattaatttaagaagaccagcacagagctttttgagagcatattcatcttaaaatctcagttactgaaggaagatattcttgatgagacagaatgcttttctttatcttantcctgatctgacttctcaaagcggatcatctcggccttttatgtcaggattaggggcaaatgttgagaagaaaatcagacaagagattcaaagaacaaactgcattcatctgacgccc

SEQ ID NO: 12850 - DNA, 592 bp, Homo sapiens
tcggcacgagcttacaaataatactccaatgaatcagtccgtaccaagataccccaatgctgtaggattcccatcaaacagtggtcaaggactaatgcaccagcagcccatccaccccagtggctcacttaaccaaatgaacacacaaactatgcatccttcacagcctcagggaacttatgcctctccacctcccatgtcacccatgaaagcaatgagtaatccagcaggcactcctcctccacaagtcaggccgggaagtgctgggataccaatggaagttggcagttatccaaatatgccccatcctcagccatctcaccagccccctggtgccatgggaatcggacagaggaatatgggccccagaaacatgcagcagtctcgtccatttataggcatgtcctcggcaccaagggaattgactgggcacatgaggccaaatggttgtcctggtgttggccttggagacccacaagcaatccaggaacgactgatacctggccaacaacatcctggtcaacagccatcttttcagcagttgccaacctgtcctccactgcagcctcacccgggcttgcaccaccagtct

SEQ ID NO: 12851 - DNA, 177 bp, Homo sapiens
acacctatcccccattctcctcgctatccctcaaccccgacatcattaccgggctttcctcttatctgcctcggggaccaagcgccgtgtgttcatcgtggaaaccatggggggttactgcggctacctggccaccgtgactgggattgctgttggggccgacgccgcctacgtctt

SEQ ID NO: 12852 - DNA, 380 bp, Homo sapiens
  misc_feature 262: n = A,T,C or G
cacataaccaccataccaggaaatgcttttcaagggatgaataatgaatctgtaacactcaaactatatggaaatggatttgaagaagtacaaagtcatgcattcaatgggacgacactgacttcactggagctaaaggaaaacgtacatctggagaagatgcacaatggagccttccgtggggccacagggccgaaaaccttgtgagtagaatggtgctgcctcccctccctgcccagtgtaccccaacaggactgcttanggtgtccctccacatcatccccaagctgatatgtgagacatcagcctctacacctgaaaaggctgctgttggaaagacaaagtgtatcacagctgccataataaagtaccccaaaccg

SEQ ID NO: 12853 - DNA, 371 bp, Homo sapiens
cggcacgaggcgaggaggagcccatcccgctggaccagctgggtggctcctgcaggacccattacggctactcctctggggcttccagcctccatcgccactgggggctcctgctggcctccctcgctcccctggtcctctgtctgtctctcctgtgaaacctgggagaccagagtcccctttaaggttcccggagctccgggaagacccgcccatcccaggactccagatgccaggagccctgctgcccacatgcaaggaccagcatctcctgagaggacgcctgggcttacctggggggcaggatgcctggggacagttcagtacacacacacagtaggcccgcaataaaagcaacaccccttcacatc

SEQ ID NO: 12854 - DNA, 149 bp, Homo sapiens; identical to SEQ ID NO: 1785

SEQ ID NO: 12855 - DNA, 123 bp, Homo sapiens
tggtacgcctgcaggtaccggtccggaattcccgggtcgactactactactactaaattcgccgccgcgacgactttttttttttttttttcccccaaaaaccctttttttttgccccttttt

SEQ ID NO: 12856 - DNA, 394 bp, Homo sapiens
cggcacgaggctaagcaggaattatcagagtggaagggaccagcacgggaagaggaacccagcacaagaaggccccgtcccatgccccttcaggttcctttttcagggaactcggttccccttctgcccctctgccacagcctgttggggggccctttccagcgccgtgcccacactgtgtcccctccactgtggcccttttcttctcttcctcccttattcttgccttcacctactgtcctaagcccaggcccagttggcccctgggggaacctcaaagtgctttgtacaaggagcccagaggtctacgccatcatgcggggctgctggcagcgggagccccagcaacgccacagcatcaaggatgtgcacgcccggctgcaagccctggccc

SEQ ID NO: 12857 - DNA, 59 bp, Homo sapiens
ttcggcacgagggttaccaatctgaagtgggagcagccgcccttttttttttttttttt

SEQ ID NO: 12858 - DNA, 441 bp, Homo sapiens
  misc_feature 26, 123, 216, 223, 225, 234, 238, 240, 243, 248, 251, 260,278, 296, 384: n = A,T,C or G
gagaaaatagcacctcacttccaganagctttaagacaaaagctggagtcccaaataaaccaggcattcccaaattactagaagggagtaaaaattcaatacagtgggagaaagctgaagatnatggatgtagaattacatactatatccttgagataagggactgaaaacacaccgtcgatgaaaaccagccactgatgaacagcctcagacctnggcagtncngggggcgcntttnanccntaacnggntaagaaggnctgatttcatgccaactngagggggagaattccaantttccaaagacacttcctctcacaggactatgaaaaccatcttttaaagaagttccaaggacaaaaagtcacttccataattatagtnctggcaacttgatcctttagatctatttttgcttcatctgggctctgggcatttccc

SEQ ID NO: 12859 - DNA, 515 bp, Homo sapiens
tcggcacgaggggcgggagaacctggaccgggacattgccctgatgaagctgaagaagcctgttgccttcagtgactacattcaccctgtgtgtctgcccgacagggagacggcagccagcttgctccaggctggatacaaggggcgggtgacaggctggggcaacctgaaggagacgtggacagccaacgttggtaaggggcagcccagtgtcctgcaggtggtgaacctgcccattgtggagcggccggtctgcaaggactccacccggatccgcatcactgacaacatgttctgtgctggttacaagcctgatgaagggaaacgaggggatgcctgtgaaggtgacagtgggggaccctttgtcatgaagagcccctttaacaaccgctggtatcaaatgggcatcgtctcatggggtgaaggctgtgaccgggatgggaaatatggcttctacacacatgtgttccgcctgaagaagtggatacagaaggtcattgatcagtttggagagt

SEQ ID NO: 12860 - DNA, 151 bp, Homo sapiens
gacctccggcctagccatgtgattgcacttacactccataacgctgctgatactaggcctactaaccaacacactaaccatataccaatgatggcgccatgtaacacgagcaaatcacataccaaggccaccacacaccacctgtccaaaa

SEQ ID NO: 12861 - DNA, 518 bp, Homo sapiens
ttcggcacgaggacggaagggctccacctcagcagcctcaacagtatggtattcagtattcagcaagctatagtcagcagactggaccccaacaacctcagcagttccagggatatggccagcaaccaacttcccaggcaccagctcctgccttttctggtcagcctcaacaactgcctgctcagccgccacagcagtaccaggcgagcaattatcctgcacaaacttacactgcccaaacttctcagcctactaattatactgtggctcctgcctctcaacctggaatggctccaagccaacctggggcctatcaaccaagaccaggttttacttcacttcctggaagtaccatgacccctcctccaagtgggcctaatccttatgcgcgtaaccgtcctccctttggtcagggctatacccaacctggacctggttatcgataaggaggctcctctacaccaattaatgtagctgctagctattggcctcccaaaagactccagtactattttaat

SEQ ID NO: 12862 - DNA, 659 bp, Homo sapiens
  misc_feature 529, 545, 609, 639: n = A,T,C or G
ttccatttcttaaataaacatgaatatatatatattttttcttttataaaactttcatggaataagggtagggtgggggcttcggtggcctggcttcctggcatcactcgtcatcaaagttctgactcaggaggaagttggcagccaagttctcatttttttcacacgcgaaataggcctggatgaccaggctctctgggaagcccagggccttcaacctctctatagcttctttctcctgcggcgtcacctggatgtagttcatctgcggggcctcctctcctatggcgcccacctccccctccacatatgagatgtccgccagctccccagggggctcgttcagcatctggatgaactgctcctggtgccggctgatttgctgcaggagagggtggggaagggaaggtaattcacagccctgggtccctcctctccccaggtcatcacagcccttgctttttcattcagtcaggcaaatatccagaggagcctgttcttgggcaaacacaacataagcagtcgacanaagcctaacctggaanaactgatgaatgtgcctttaagtgagccagaaataagccggggacggtgggtcaaactgtaatnccagactttgggagcaaagcagtgatactnaagtagattcagtcacctgt

SEQ ID NO: 12863 - DNA, 456 bp, Homo sapiens
  misc_feature 49, 163, 412: n = A,T,C or G
tgctgcttaatacattttattcaggtctgtcattacacttgcgtgaatntcatcgggtgaggttttatttgcaggaggagaaggtcttccagaagaagttcctgcagggcattctgtcccggcgcgcggattgctgggggggtgcgccttcctgccgccttgncacctcccgagcttcctctcctatgaggggcccggcactggcctggggaggtccactcaaaccaccaagcgaggaaagtcaggaggctgcttttccttattcctgccgcttcctgcatatgctcgctgtctcggccggtggggcaccctccaggggcagggcagcggtggccgtggcccggaagagcagcagcagcaggaggccgggggacaatggcatcttgtgggctgactggaacttctctcccancctgctgctgctcttccttcctggcagccctgaaatcaatgttt

SEQ ID NO: 12864 - DNA, 542 bp, Homo sapiens
  misc_feature 424: n = A,T,C or G
tcggcacgagggctcacaccaggcagccttctagtggtctccctggccaccttgggcagagctgggtcatgcagcaccccatccttacccggtgccctctccttgccagcttctccccaggccagagcggccatcgcgtaaaaagaaccagggtgtccccgggacaggccgtcccccaccccatcctgtagaagtccattccccttttccctcctgtgctctgtcccccaaggagtcatggaactcagggtactgggcctcaacgggaacctgagacagctccagcttcgcagcccttcccggagctacagggggatcctctagcatggggggtgtgacttggttcctttgaccaggtcctgtgaggaagcctggagcaagggtctcccccagcaggatgggtggggcctgctctggagctgancccgtggccgctcacaggtgtccttagtggtgttgcagctgtctactggctgcatgtgctgtgaatatcccaaggaactggctgtggaatgcgtgtttgggtcagtctgtgccctctc

SEQ ID NO: 12865 - DNA, 513 bp, Homo sapiens
ttcggcacgaggacattcaccactgtactgagtgaccaacaggtggtggagctgatccctgggggtgcaggcatcgtcgtgggatatggggaccgttctcgtttcatccaactggtccagaaggcacggctagaggagagcaaggagcaggtggcagctatgcaggcaggtctgctgaaggtggtaccacaggctgtgctggacttgctgacctggcaagagttggagaagaaagtgtgtggggatccagaggtcactgtggatgctctgcgcaagctcacccggtttgaggacttcgagccatctgactcgcgggtgcagtatttctgggaggcactgaacaacttcaccaacgaggaccggagccgcttcctgcgctttgtcacgggccgcagtcgcctgccagcacggatctacatctacccagacaagctgggctacgagaccacagacgcgctgcccgagtcttccacttgctccagcaccctcttcctgccacactatgccagtgcc

SEQ ID NO: 12866 - DNA, 637 bp, Homo sapiens
  misc_feature 470: n = A,T,C or G
tcggcacgaggatagcatccaagagttccggctgtcagggtggctggcccagcaggaggatgcacaccgtatcgtactctaccagacggacgcctcgctgacgccctggaccgtgcgctgcctgcgacaggccgactgcatcctcattgtgggcctgggggaccaggagcctaccctcggccagctggagcagatgctggagaacacggctgtgcgcgcccttaagcagctagtcctgctccaccgagaggagggcgcgggccccacgcgcaccgtggagtggctaaatatgcgcagctggtgctcggggcacctgcacctgcgctgtccgcgccgcctcttttcgcgccgcagccctgccaagctgcatgagctctacgagaaggttttctccaggcgcgcggaccggcacagcgacttctcccgcttggcgagggtgctcacggggaacaccattgcccttgtgctangcgggggcggggccaggggctgctcgcacatcggagttctaaaggcattaaaggaggcgggggtccccgtggacctggtgggcggcacgtccattggctctttcatcggagcgttgtacgcggaggagcgcagcgccagccgcacgaagcagcgggcccgggagtgg

SEQ ID NO: 12867 - DNA, 553 bp, Homo sapiens
cggcacgaggggagcttgctgagtgagagatggagcctcatggtgtacaactgagggtagttaactcatcacttctcccaagcactcgatcccagcttcacccactggtgttgctttgcttgaactgttcaagccttttatagccttaccataagtatttagatatggtgtccttttctgtttttggggggggagttttgttgtgtttttttaaagtaagtgcttaagtattaactttgggttgtcccctctgtatgtttcgaaggggttttggttctttttgcttctgttttcttaaacatgttttccactcccacttgggcattttggaagctggtcagctagcaggttttctgggatgtcgggagacctagatgaccttatcgggtgcaatactagctaaggtaaagctagaaacctacactgtcactttactgagatttctgagtatacttttcatattgccttaatgtagcagtaatgtgtttatgcatttgtttctttgcacagacattttgtcaaatattaaaactctacttttttatggcacata

SEQ ID NO: 12868 - DNA, 328 bp, Homo sapiens
aaaaatcccccccccttgccaaaaggggggccaaaaaaaccccttaaatttttttttcccaaagaaaggaaggaaggaaaaacacgggggggaaacccaaaatcccccccccctttggccttgaaagaaagggggcaaccaattggggccttgaaccccctttttaacgggaaaccaaaaataaaaaccccagcaccataaatccggggaaaccctttctttgggaaaaactttgaattaattttttggagggtataaaaattttcccttgaaaacaaaaaaatttttaaattgggcttttctttccacccgttggggaaaaaatggg

SEQ ID NO: 12869 - DNA, 588 bp, Homo sapiens
tcggcacgaggctgattctcccaggattcatagacttcatagctgatgaggtggacctgacctcagccctgacccggaagatcacgctgaagacgccactgatctcctcccccatggacactgtgacagaggctgacatggccattgccatggctctgatgggaggtattggtttcattcaccacaactgcaccccaaagttccaggccaacgaggtgcggaaggtcaagaagtttgaacagggcttcatcacggaccctgtggtgctgagcccctcgcacactgtgggcgatgtgctggaggccaagatgcggcatggcttctctggcatccccatcactgagacgggcaccatgggcagcaagctggtgggcatcgtcacctcccgagacatcgactttcttgctgagaaggaccacaccaccctcctcagtgaggtgatgacgccaaggattgaactggtggtggctccagcaggtgtgacgttgaaagaagcaaatgagatcctgcagcgtagcaagaaagggaagctgcctatcgtcaatgattgcgatgagctggtggccatcatcgcccgcaccgacctta

SEQ ID NO: 12870 - DNA, 525 bp, Homo sapiens
ccctgaagtcctcttttctccacagaatatttacaaacagggaaggggtggaggccacttccgccaccaaaggggctaggggggggggcagtgctaagacacgcctctgcgcagggagagttcctgaggagggcccagtgtgaccacagtgccctcaggggccaggtggttccagacggctcaggccaggtcggcggtgggtgagcccagctgcttggaggccaggaggaggcgtgtggctgcactctcagactccgcctgcagccgccggttgttgtgtctcaggctccgcacctcctcctccagggccgccctgtccgccttctccttctgcaggtcctcctgcagcttcctgagcatggactccaagtgagagaccttctctgagaggttcccaggctctggctcagcatcagattttggagttcccttagggtctccactctctgggatgggctgtcctctcgggacagcgactccagaatggtgttgcagtagaggcatctcgagatggctgcactcgtc

SEQ ID NO: 12871 - DNA, 457 bp, Homo sapiens
  misc_feature 208: n = A,T,C or G
tcggcacgaggtcttaaataattttattggtattgctttcactaatagtctttttcataagtcattattattcataagtcattgtctgtttggcttttgttttaataagggaaatttttatcctattttgctattctcctgaggagcatgctctttaacttcacttttgttttttagtcaagttgatattaatccctatttctttatnaggttgcttgctgaaacagatactacagtgactagtaatatcctaaaatttcctctaaaagccttgcacttattacatttgtacaactgggcaccaatccgctgaagagctcatgaattgaaaatggggctttccagggaatgaagaaactctcctacatccgcattgctgataccaatatcaccagcattcctcatggtgatagaagattctccaaaacattttgaaaaatttaaattcgaaggcttt

SEQ ID NO: 12872 - DNA, 319 bp, Homo sapiens
cggcacgaggcctccttggtttggatctcgaattcggatcgtcttacgctccctcttgggagcaatctggggtggctggttcatcaaaactggggcgggggccacgccagtgggaaactgctgcaccccttgggctggatagtaggcgccagcgtaggtcccaaattctgtagggcttgcacctggatagaagcctggggctcctggctgcacagggtactgctgtgtcgggacaacgtatgtggaacgccccccctcgattaagaacaagtccacggtgcggcctacaggttctgggcatccgagggcctggggttgg

SEQ ID NO: 12873 - DNA, 426 bp, Homo sapiens
  misc_feature 375: n = A,T,C or G
cggcacgaggttttggaaaaacctcaaatctttaatttctctcttcgcctggtgcagcccagacgtgagacacctgagcttcaaaaacaaacatggtaaaaacagccccagggcccgagagccgttgagttaagtgcgagtgggggagtcccctctccaacacccctcaaagtgcatcgggactggccccccaaagctgggcccataacacccttgataaatctacgggccgacaggcgggagggtggctgcccccagggcccttggggctaaggggacagcggtgtggtttggctttagtgcaaaaagctggtttctttaaaggcactttgagtggtgggacccctccccgacctggcgggggggagggttcanggtcagccccgcccccccaccccaagtaaaagcagaccctgcagctggtga

SEQ ID NO: 12874 - DNA, 542 bp, Homo sapiens
  misc_feature 433: n = A,T,C or G
tcggcacgaggattatttcagaggtcactgaagactgtgattacatgcacctgccttagaaggtaggattttcttcccaggacctcctatcaccctaccctgcttcttgaggtccctggagccccaggtgggctgaggggcagggagccggctgtgcccagtatgcctcctggaccctccagttctgccacaggtctgccgatgccctgtccactgcctacacatgacagacaagtaaccccctcatgggggatggggacctacctggctcctcagccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttangcgtcacgccaaaggccagcctcctggccccaatacccattttggaagcccctgtggccgtgtggatgtcggtaacagttgtataaaataaattctatttatcgctatt

SEQ ID NO: 12875 - DNA, 821 bp, Homo sapiens
gactggctagaaatttttattatttgcgaggcagtaagtgctcttgagagcaggcacagtgctgggaacactaggccccttcgggacaaaccagggccttaaggaaaggggcttcggctttggcttgagggaaggcacataactgggacaggccctggcggggagtattcagaagccaagtgggttgctggtgaccacaccaccccgctccaccaaggccttggagatgcttttgaagttgcggtagagctcttgctgccaggggtcagactgcagggcggccatgccctctcggatccgagctgcagcctcgatacaccaggtgtcacagagcattttctcatgctgggccgtggggtgggcctcactcagggatcttgaggccctcgagagaaacaccaccatggcatagaggtcgatggccccgtctgccagccgctgcagcaggaaactgtccatgacaatccccttcttgtgtttaatcagcttggcctccaccacagtggcaaactgcttccagagcccgtatgccagctgcgcatttcgactcaactccgggtggacaagtcccgctgagatcaggcccgcgccccagcctgccccgccgctaagtctttttgcccgcctctcctagcaggagggccagcatttcccaaagggatttctttagaggcactgcaaagcccagaagaagctccttcccttggttccatacagcccctgaggagcaacaaacaggccaaagaattttattttgttcccctaaaaagttcgggaagaatgcgagaaatctgggagaaacacgccccttggtgccaaat

SEQ ID NO: 12876 - DNA, 269 bp, Homo sapiens
gctttttttaaacttaatattctttcccgtttccccccttatataaaacggggggtttttgggggcccctttgtttggaacgaaacggctgcatggggtaaaaaaaactgtttttttgggggttttggggggggggtgttatggattttttttcctttgcgtgtttgaaacaccgtctccccaaaatctcaacccccacttgctttttaatttgtcctcaatccggggtgccaaatttacccggccctaaacccgccttctttttaaaa

SEQ ID NO: 12877 - DNA, 677 bp, Homo sapiens
  misc_feature 539, 573, 606, 619: n = A,T,C or G
tttccaatccaagccaacatttattgttgcacaagcctgttgcagtcctgaggggatcttctggcagaggtgtgggtaggaagctgagtggccactggggtgaagggcagacagaggaggctgtgaccagcaggctcctatccagatgatacatgagatggaggcctcctcagccacactccagggagggtggggtggcaaggggaattcagggataatggcattaataatacaagtggtaaacaaataaccaagaggatctggctggttacgatacacaaaagttagcagtaagagtccgtgctttcacattcctatcagacagatctgagttcaaatcctgtatgtgtagcagggtgaggtatctgctttctgtcagagcccatgggtgcacatctctgagcctagttacaacagttggcacataggtgggtggacaaggagggcagctcttgattcctgttgcttccacagcacagagagataagtatggctggtgtgacagatcccacttgacagatgaagccactgagacttgnagagcaggtaggcttagtccgagacctagcattncgtggtggctgccttctcatttcccagaggctncagagtccctcangtccttggttgcaccgtcctcccaccagactgacccagggccagtccacttcggtggg

SEQ ID NO: 12878 - DNA, 276 bp, Homo sapiens
gagaagacgacagaagggcaaaagaacacaaagagagcaagagatggaacttgcagcatcaagccctttcataatggcactattccactcataagggtggagccctcgtgaactaaacacctcccattaggccccaccgcccaacaaagttccactggaggttacatttcaaacacatgctttttggaggacacagtcaaaccatagcaccaactatctgccttttccactggggggataaaaaaaaaaaaaaaaaaaaaaaaaaagtcgtatcga

SEQ ID NO: 12879 - DNA, 284 bp, Homo sapiens
tcatgtttaaaacagttttaatcacttgagttttcatacaagcactgctttgttttcccacagcctcttgattattataggtattttccgaataatagaagaaaaaaaaaatctgtaaggcaaatttactagtctacctccatgacaacagaagatcttctcatccacaatggctgctataggcagacagttaaaacaatcagtgaaggtcttccacaatttaatattaaatcttcgtttgcattcatcatagaatccataaatgcgattgatgctagcacact

SEQ ID NO: 12880 - DNA, 542 bp, Homo sapiens
gggaatgtgggtggagggggatcatagttctccctgagtgaggcttgcctgctcctctggcccctggtcctgtcctgttctccagcatggtgtgtctgaagctccctggaggttcctacatggcagtgctgacagtgacactggtggtgctgagctccccactggctttggctggggacacccgaccatgtttcttgcagcaggataagtatgagtgtcatttcttcaacgggacggagcgggtgcggttcctgcacagaggcatctataaccaagaggagaacgtgcgcttcgacagcgacgtgggggagtaccgggcggtgacggagctggggcggcctgacgctgagtactggaacagccagaaggacatcctggagcaggcgcgggccgcggtggacacctactgcagacacaactacggggctgtggagagcttcacagtgcagcggcgagttgagcctaaggtgactgtgtatcctgcaaggacccagaccctgcagcaccacaacctcctggtctgctctgtgaatggtttctat

SEQ ID NO: 12881 - DNA, 696 bp, Homo sapiens
  misc_feature 494: n = A,T,C or G
ttcggcacgaggcgagcacggcggcggcgtcgtctcccggcagtgcagctgccgctaccgccgccctctgcccgccggcccgtctgtctacccccagcatgagcggcctgcgcgtctacagcacgtcggtcaccggctcccgcgaaatcaagtcccagcagagcgaggtgacccgaatcctggatgggaagcgcatccaataccagctagtggacatctcccaggacaacgccctgagggatgagatgcgagccttggcaggcaaccccaaggccaccccaccccagattgtcaacggggaccagtactgtggggactatgagctcttcgtggaggctgtggaacaaaacacgctgcaggagttcctgaagctggcttgagtcaagcctgtccagagttcccctgctggactccatcaccacactccccccagccttcacctggccatgaaggaccttttgaccaactccctgtcattcctaacctaaccttanagtccctcccccaatgcaggccacttctcctccctcctctctaaatgtagtcccctctcctccatctaaaggcaacattccttacccattagtctcagaaattgtcttaagcaacagccccaaatgctggctgcccccagccaagcattggggccgccatcctgcctggcactggctgatgggcacctctgttggttccatc

SEQ ID NO: 12882 - DNA, 631 bp, Homo sapiens
acctgatgttttagttagcctatgtaaccccatcacaggttgatgtacagtttccattaggttctggaggaaatactgaaagcagtgtgtgtacctgcccactgccttcacacaccccggcctgggtttttaattacttcaagcaggccagcctcaggtgcccacagccctgagaaccagtctgtgcccagtttctttctcttctctcagattatgaactccccaaaggcaccatccaggtttttaccccgcttgtcaaattcccctctggcccagggctggctgctcagcaggagtgtttaataagcacttaattgcccggtgagtacagaccattccagctcaccttaactgtttcctggctgactcgcctctcggcctgattgccctgctcatctggctgagtgagctggaatgagtgtagtggtagtgccacctataggttcctcttaccttggtcttatttcacaggagcacttcccgaacgagtttacctcgggagatggaaagaaaggtatgtcccatgaaccatggtggctgcagttgaggagtgggccttcctctccccttctctgtctgcttcctccagtcaggatctgccacacagatcacatctgcatgcctggcacct

SEQ ID NO: 12883 - DNA, 464 bp, Homo sapiens
  misc_feature 177: n = A,T,C or G
agagccagctactggagtcattccgtttccactcattcacccaacctcagggttctccccatctgagccagcctgctggtgtgacttactcatcctccattcctctgcacttgcagactttctgagccagggttttcttttagtggaaacaaatggttgatggatccagatccttanaaaaggagaggatgggggtagagtctcccaagccaaaattttgacatttgagtgctttcgtaagccctgtacatgtactattaattcagtcattcagccaagcctcctcctctagcagcaatttccagctgtttaacactatcctgggcaaatgttttaccctgtcctccagcctccctgcttcccttctggccctggaagactgagtctggacggcagaatggagggactgggaggctgtggctgcctccctccctcagcccggctgggactgtctcccggacccc

SEQ ID NO: 12884 - DNA, 462 bp, Homo sapiens
tcggcacgaggtttttttttttttttttcaaaaggggtcggaaatgcaggggggcaataatacttaattgaaaactaaaactcctgggttaaaggaatcctcccacctaaccctcttgattacctcctttaaaaggcttttcctattacccccagttatttttaaattttttgaaaaaatggggtctcctttttttcccaaggttggtttaaaactctgggcctaaaccaatcttcttgccaaaaactccaaaagggccggaattataggcttaacccattgcccctggaaaacccgggttttttttaaaacctaaattttacccaaagggttaaaaaccaagggaaaaggggatttttggaacgaaatttttgtgggtttgggttttccaaaaccctttttttttcaaaccttttaaactaaacacttttttgccccaatttgttgtttgcatttgaaaac

SEQ ID NO: 12885 - DNA, 401 bp, Homo sapiens
  misc_feature 259: n = A,T,C or G
gccccaaactgggaaagaagatgctaattaaagtgaagacgctgaccggaaaggagattgagattgacattgaacctacagacaaggtggagcgaatcaaggagcgtgtggaggagaaagagggaatccccccacaacagcagaggctcatctacagtggcaagcagatgaatgatgagaagacagcagctgattacaagattttaggtggttcagtccttcacctggtgttggctctgaaaggaggaggtggtcttangcagtgatggaccctccattttacctctttaccctgtcgctcataatgaggcatcatatatcctctcactctctgggacaccatagccactgccccctcccctggatgcccagtaatgtatgtctactggtgggagactgtg

SEQ ID NO: 12886 - DNA, 567 bp, Homo sapiens
  misc_feature 311, 397: n = A,T,C or G
ttcggcatgaggacatgaaacacaggcacagggttcacagtaagcacatggacaagtgggcacagggtcataggccagatgcacatccagccatggctgggccagacactgggacacagtggtggtgtcacacacagaccacaggggggacacatggatttgacagccacaatgcacagaccaggctacagagctcgagggacgtgggaaggggccttttggcactactgcactggaatcatgtgagacaaaggtagcaggacactctggcggtgcctggggcggtccccttgcggcctctctaggcttantccgtcttccacactttgttgagcagcttcaccacttcatcatagatgacaaacactatggccacatccaggcagacccggcccangcgggggacagtgcccttgtagaatgccttgagcccctccttcttcaggatctgcaagccgcagtcccacgtgttccggtatttgtgcgcctccaggccctgcatccgggtcttaatcacatccagaggagtgtttccaaagacactggctgcgcctgcaatagctccga

SEQ ID NO: 12887 - DNA, 56 bp, Homo sapiens
gtgcgctagacagccgcttatgcaccaactagaagaagaaaattccggggatgttg

SEQ ID NO: 12888 - DNA, 222 bp, Homo sapiens
tggtacgcctgcaggtaccggtccggaattcccgggtcgacatcatcatcatgatcgctcgacatcgatacgactttttttttttttttttttttttgggtaaaaaaggggggaattttttaaccccccgggggggggtaaaagggtttttggggggaagggcccccttgccgggaaattttgcaaaaattttttggcccttttgggggtttttccaaaccc

SEQ ID NO: 12889 - DNA, 567 bp, Homo sapiens
tcggcacgagggaccttgcttcccaaataagacatgtcagaagatgctgataatcctcacttctgcattacaaatcgctcataggtgcatctgcaggatcttacttggatccagagtgctagctgcaaaagcttctgggaattgtacacttaactctgaagttttatctttaatataggaagtgccgcgtatgatgctgtccttgacagaaatgtggccattaagaagctcagcagaccctttcagaaccaaacacatgccaagagagcgtaccgggagctggtcctcatgaagtgtgtgaaccataaaaacattattagtttattaaatgtcttcacaccccaaaaaacgctggaggagttccaagatgtttacttagtaatggaactgatggatgccaacttatgtcaagtgattcagatggaattagaccatgagcgaatgtcttacctgctgtaccaaatgttgtgtggcattaagcacctccattctgctggaattattcacagggatttaaaaccaagtaacattgtagtcaagtctgattgcacattgaaaatcctggac

SEQ ID NO: 12890 - DNA, 435 bp, Homo sapiens
  misc_feature 20, 46, 132, 399, 408, 413: n = A,T,C or G
gatcagtgggcatggcttgnatgggaggtatgctcctctgcactgnccctctggcaccaggcaacatggcattgtcagctctccatcctcctccttctcagctgctctgttctcgacagcttcggggaactnattccgcagccttccaatgaagtcaatctactggattcaaaaacaattcaaggggagctgggctggatctcttatccatcacatgggtgggaagagatcagtggtgtggatgaacattacacacccatcaggacttaccaggtgtgcaatgtcatggaccacagtcataacaattggctgagaacaaactgggtccccaggaactcagctcagaagatttatgtggagctcaagttcactctacgagactgcaatagcattccattngttttaggnacttncaaggggacattaacctgtact

SEQ ID NO: 12891 - DNA, 463 bp, Homo sapiens
  misc_feature 14, 30, 32, 55, 60, 79, 91: n = A,T,C or G
gcgaccgcgcggtngaccgacgccggcatngnaccgagtgggggccccgcgcggngcctnccctctccgcgccgccaanccggggactgcncgcgggtcgggtttcccgccagctcaggtggatctcgagccagaggggaaagtatttgtggtaataacccttaccgggagtttcactgaagctactctccagagagaccggatcttcaaacattttaccaggaagcgccaaagggctatgcgaaggcgagtccaccagatcaatggacacaagttcatggccacgtatctgaggcagcccacctactgctctcactgcagggaagtttatctggggagtgtttgggaaacagggttatcagtgccaagttgtgcacctgtgtccgtccataaacgctgccatcatctaatttgttacagcctgtacttgccaaaacaatattaacaaagtggattcaaagat

SEQ ID NO: 12892 - DNA, 612 bp, Homo sapiens
  misc_feature 142, 321, 480, 546: n = A,T,C or G
ttatgttaactgcttaatttatttagtctgatcaatggcccagttcaggcccaccactcctacacttgctggggacagccaggaaacaaccagccacacaatgctgaactgtgctgctgctgggagtccagggctcagcctnaaagcaagcttgcaaacttcacacataagtacagtctatatagcaagtaaactctgaccagagatgacatctggtcccacaactcatcaggtctatgtacaatatttcacataccacccaatagataagataatattaacagcaaccactctcctttatcaattccccctgctccaatnacaaccaccacacattgcattaataccccaaacccattcccaatttattaaatatggtgcaagctcatagacacttagaagaggcaaatctagttgtgatgaagagttcctagagctctgggagccaagatggagggttttccagtacctgcacatgtnggctcaggaggatgctggccaggagctaatgagttgggagagccaacatggggggtagaagtcagntgggccagctcagggggctatctctctcaggatctcagctttgggacttggcaacacctctttcca

SEQ ID NO: 12893 - DNA, 590 bp, Homo sapiens
tcggcacgaggagggtaggggcactgctgcaacttctgctttcatcccatgcctcatcaatgaggaaagggaacaaagtgtataaaactgccacaattgtattttaattttgaggtatgatattttcagatatttcataatttctaacctctgttctctcagtaaacagaatgtctgatcgatcatgcagatacaatgttggtatttgagaggttagtttttttcctacacttttttttgccaactgacttaacaacattgctgtcaggtggaaatttcaagcacttttgcacatttagttcagtgtttgttgagaatccatggcttaacccacttgttttgctatttttttctttgcttttaattttccccatctgattttatctctgcgtttcagtgacctaccttaaaacaacacacgagaagagttaaactgggttcattttaatgatcaatttacctgcatataaaatttatttttaatcaagctgatcttaatgtatataatcattctatttgctttattatcggtgcaggtaggtcattaacaccacttcttttcatctgtaccacaccctggtgaaaccttt

SEQ ID NO: 12894 - DNA, 391 bp, Homo sapiens
  misc_feature 32, 382: n = A,T,C or G
ggaactcagcactcatcctcacccagcaggcnataagggtttcggccagccaggctggaccctggagccgaggttggggtctcctcatccccttctccctcctcatccgcatcccggtcctcctctccctcctcctcacaggagctgctcagctcttcctcttcctcctcctcctcgtcacctgctggccccaccctgccctgcaaaaccaccagctccgtggtctctggatgggactcccaggtgcctttctgttcactgtagcctgggggatgaaaacacaggctgaggcggccgtccactgccagccgcaagagactgttggctgctctgtacacatcattccgagccgccttggctgtcttgtaaacacgtttctctngccaggctt

SEQ ID NO: 12895 - DNA, 442 bp, Homo sapiens; identical to SEQ ID NO: 1855

SEQ ID NO: 12896 - DNA, 600 bp, Homo sapiens
  misc_feature 415, 556, 592, 597: n = A,T,C or G
catgttcacttctttatttttgatacaaatgtacatgacacgtcttgacagcccacccaccaccacacaggtagggcctggccccagggaagaagcgggatggggagagagctggtgggtcccaccgtctgcctctccagccttcccaggctgcagccaggttcccaggcctccagagggtgggaccacagcaggtgcaggtagtgatggtgggtgctggccttgcagaggttacggggaggggactcaagctccacagccaccaagctgagtcggggaccccggggaagccagccccaaggctcaggtgctcagtcctccacccctaagccagcacacattccccctccaacgcaggaagcaggaaggagatgggaggggaagtggttttttgatttaagttccataagagaanggggcgagagtggggaagggattaagggaaggcagcttggcaaggaccaaaacttggctaacccggacagttccctggcttccaagttgggggaaagggaagctgattccccatgcttggttccactgctctggtcccctnacccttcaaacttcagattggaacaaggcctccggnaaggnatt

SEQ ID NO: 12897 - DNA, 561 bp, Homo sapiens
  misc_feature 440, 514: n = A,T,C or G
ttcggcacgaggccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggtaagagtgagggcatcagggcaggctgagctctgggtagagaaagggaagggctgagtgggtgggttgaaggggtccaggttcaaggttacatcaaacccgccccccangctccaccctcatccagctgccctccctgccccctgagttcatgcacgccgtcgcccaccaaatcactcatcangccatggtggcagctgttgcctccgcggccgcaagcttattcccttt

SEQ ID NO: 12898 - DNA, 577 bp, Homo sapiens
tcggcacgaggggctccctctttcctcccaatcctaagctcctgacaagtggccaggtggctctgggccctcctgccccgtgcctaggtcaggggtcctggaataccccgtagctctggcaccaccacactggcctctgatggcaagacttggcccctccacctgtccctaacggacggcaggtcaggaaagccaggactcaggggagaagcaaacccccaggattgaaggctagggttctagggcctttgggtggggagggcccgggccggacagcctcagctccgtcccctgccccacaagattcacctgggcctccagtcccacgctggccccaactgctgcagctctcggcttccgcccaacagcctctggaggtgaggcgggagcatgccctcagcgaggctgggcggcgggtcctgctgtgccatctccctgtgcgcctgagcagatcaatccaccagtgcaaaacagggctaacggcacctgcaggacagcagcacgctccatccctcatgctcagctgcctctgcggccacggacttctgcccttcatctgctctctcttactctcctg

SEQ ID NO: 12899 - DNA, 615 bp, Homo sapiens
acacctcagtcgtccacccagtgctctggcttctgctgggatcctggtccctcaccactgccctgcgccagaggagcgcactggcgctgcagcacaggcccgtggtgctgttcggagacctcgctgggactgcgccgaagctcccaggaccccagcagcaagaggccgtgacgctgcccccgaatcttcacctgcagatcctgagcatccctggctggcgctacagctccaaccacatggagcactctcagaatctccggaaaggccatcgaggggaagcccaggctgacctccgccgtgtcctgctgcggctctaccacctgtatgaagtgggcgaggacccagtcctgtctcagccagtaacagtgaatctggaggctgtgctgcaggcgctggggtccgtggtggcagtggaggagcgctcgctcacagggacctgggatttgagcatgctgcaccgctggagctggaggacggggcctggccgccacagaggtgacaccacctctccctcgaggccaccaggaggccccatcatcaccgtccacccaaaggaaatccggacgttctttattcactttcaacagcagtgagccctgggcagatgccccgtcc

SEQ ID NO: 12900 - DNA, 427 bp, Homo sapiens
  misc_feature 359: n = A,T,C or G
gcaattacagagtggtattcagttaacagaacaacaattatttcgtataagctgcatcagagacaactgaagatgaaaaaactaccatccccatatataactaatttgtgctgtgcccaacaagaacctgctttaaatttccatgccaatttacaacccccatactgtaccaggcaaggttagtggctattgaaaataccaccaggacagggctatctaaagacacattcggtagtgtgttaactatacaaaaaaagacactgtacagtttaaaaacaaatcttacacagccttacatttcaatttttttctttaaaaggagtgagttgtgtacaggggggttaaatgctttatagacnagaaaaaaaaaaactgcgctagaaccaacttattcatcatcatcatcttcttcttcatcttcatcttc

SEQ ID NO: 12901 - DNA, 681 bp, Homo sapiens
  misc_feature 133: n = A,T,C or G
gacttggcacgagtaaaatgtgcttgtctttgtgggctgtttcatcttctgttggtttccaaaccacatcctttacatgtatcggtctttcaactataatgagattgatccatctctaggccacatgattgtncaccttattgcccgggttctcagttttggcaattcttgtgtcaacccatttgctctttacctactcagtgaaagcttcaggaggcatttcaacagccaactctgctgtgggaggaagtcctatcaagagagaggaaccagctacctactcagctcttcagcggtgcgtatgacatctctgaaaagcaatgctaagaacatggtgaccaattctgttttactaaatgggcacagcatgaagcaggaaatggcactgtgattttggccattcaactcactacctggagagaacttagtaactgttaaaattcctattcggcagatcagaacttgctgttgcttagctaatttattaggcaattgcatgattgactcagaaaatgcaagacattttttctctacactagactttattttttctcttttcatttcctaataattagaatatgagaaaagactgtaaatcactacatataatacatatatgtatatatatgtatttgcacacacacatgtacacacatgtacattatatatatttcacattta

SEQ ID NO: 12902 - DNA, 598 bp, Homo sapiens
  misc_feature 55, 467: n = A,T,C or G
ttcggcacgaggccgcccacgtgcccccatcattgctgtgacccggaatccccanacagctcgtcaggcccacctgtaccgtggcatcttccctgtgctgtgcaaggacccagtccaggaggcctgggctgaggacgtggacctccgggtgaactttgccatgaatgttggcaaggcccgaggcttcttcaagaagggagatgtggtcattgtgctgaccggatggcgccctggctccggcttcaccaacaccatgcgtgttgttcctgtgccgtgatggaccccagagcccctcctccagcccctgtcccacccccttcccccagcccatccattaggccagcaacgcttgtagaactcactctgggctgtaacgtggcactggtaggttgggacaccagggaagaagatcaacgcctcactgaaacatggctgtgtttgcagcctgctctagtgggacagcccanagcctggctgcccatcatgtggccccacccaatcaagggaagaaggaggaatgctggactggaggcccctggagccagatggcaagaaggtgacagcttcctttcctgtgtgtactctgtccagttccttt

SEQ ID NO: 12903 - DNA, 175 bp, Homo sapiens
actctgggttccacagcacagcagacatggaacgctgaagtctctgaaagtgaagttgtaaaaagaaaaggaatgaaataaccgacccatcatcttctcacccaccctcattgcattccgctgtagtgaaaggacgagccatttctgggcacgtggcagcagtcgctgatctccc

SEQ ID NO: 12904 - DNA, 622 bp, Homo sapiens
  misc_feature 238, 474: n = A,T,C or G
ttcggcatgaggatccggtactgtgcccaggatgctttcttccaggtgaaggaggtggacgtgggtttggctgccgatgtaggaacactgcagcgcctgcccaaggtcatcgggaaccagagcctggtcaacgagctggccttcaccgcccgcaagatgatggctgacgaggccctgggcagtgggctggtcagccgggtgttcccagacaaagaggtcatgctggatgctgccttancgctggcggccgagatttccagcaagagccccgtggcggtgcagagcaccaaggtcaacctgctgtattcccgcgaccattcggtggccgagagcctcaactacgtggcgtcctggaacatgagcatgctgcagacccaagacctcgtgaagtcggtccaggccacgactgagaacaaggaactgaaaaccgtcaccttctccaagctctgagagccctcgcgtcccaggccccanccagggggccggccttgtcccgcctcatccacagaaagggaggatgggcgatgacagttgtttctatgccttctgacccagtttcccagtttataactttatgacaatgagtttctcaagcccaaggccttatcttcaccccacaaac

SEQ ID NO: 12905 - DNA, 638 bp, Homo sapiens
tcggcacgaggggccgagcaggaggcgccatcatgggagtggacatccgccataacaaggaccgaaggttcggcgcaaggagcccaagagccaggatatctacctgaggctgttggtcaagttatacaggtttctggccagaagaaccaactccacattcaaccaggttgtgttgaagaggttgtttatgagtcgcaccaaccggccgcctctgtccctttcccggatgatccggaagatgaagcttcctggccgggaaaacaagacggccgtggttgtggggaccataactgatgatgtgcgggttcaggaggtacccaaactgaaggtatgtgcactgcgcgtgaccagccgggcccgcagccgcatcctcagggcagggggcaagatcctcactttcgaccagctggccctggactcccctaagggctgtggcactgtcctgctctccggtcctcgcaagggccgagaggtgtaccggcatttcggcaaggccccaggaaccccgcacagccacaccaaaccctacgtccgctccaagggccggaagttcgagcgtgccagaagccgacgggccagccgaggctacaaaaactaaccctggatcctactctcttattaaaaagatttttgctgac

SEQ ID NO: 12906 - DNA, 668 bp, Homo sapiens
ttcggcacgagggttcgacagtcagccgcatcttcttttgcgtcgccagccgagccacatcgctcagacaccatggggaatgtgaaggtcggagtcaacggatttggtcgtattgggcgcctggtcaccatggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaagagcgagatccctccaaaatcaagtggggcgatgctggcgctgagtacgtcgtggagtccactggcgtcttcaccaccatggagaaagctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccaaaaaactgtggatggcccctccgggaaactgtggcgtgatgg

SEQ ID NO: 12907 - DNA, 520 bp, Homo sapiens
tcggcacgaggaacagctggtgcccagctgcgtgactgtgcagcgctgtggtggctgctgccctgacgatggcctggagtgtgtgcccactgggcagcaccaagtccggatgcagatcctcatgatccggtacccgagcagtcagctgggggagatgtccctggaagaacacagccagtgtgaatgcagacctaaaaaaaaggacagtgctgtgaagccagacagggctgccactccccaccaccgtccccagccccgttctgttccgggctgggactctgcccccggagcaccctccccagctgacatcacccatcccactccagccccaggcccctctgcccacgctgcacccagcaccaccagcgccctgacccccggacctgccgctgccgctgccgacgccgcagcttcctccgttgccaagggcggggcttaaagctcaacccagacacctgcaggtgccggaagctgcgaaggtgacacatggcttttcagactcagcagggtgacttgcctc

SEQ ID NO: 12908 - DNA, 561 bp, Homo sapiens
tcggcacgaggggtgtttgcagactatgaagcctacatgcagtgccaggcacaggtggaccagctgtaccggaaccccaaggagtggaccaagaaggtcatcaggaacatcgcctgctcgggcaagttctccagtgaccggaccatcacggagtatgcacgggagatctggggtgtggagccctccgacctgcagatcccgccccccaacatcccccgggactaggcacaccctgccttggcgggaccagcgggcatttgttttcttgctgactttgcacctccttttttccccaaacactttgccagccactggtggtccctgcttttctgagtaccatgtttccaggaggggccatgggggtcagggtggttttgagagagcagggtaaggaaggaatgtgctagaagtgctcctagtttcttgtaaaggaagccagagttgacagtacaaagggtcgtggccagccctgcagcttcagcacctgccccacccaaagtgggagtcaggtggagccacctgctgggctcccccagaactttgcacacatcttgctatgta

SEQ ID NO: 12909 - DNA, 585 bp, Homo sapiens
tcggcacgagggcagaggacggcaccacctccaatactttgtgagcagcggttccatcgcagtgaacgccgactcttcggtgcagttgttggccgaagaggccgtgacgctggacatgttggacctgggggcagccaaggcaaacttggagaaggcccaggcggagctggtggggacagctgacgaggccacgcgggcagagatccagatccgaatcgaggccaacgaggccctggtgaaggccctggagtaggcggtgcgtacccggtgtcccgaggcccggccaggggctgggcagggatgccaaggaggccaccagagggcagtgcaggcttctgcctgggccccaggccctgcctgtgtagaaagctctggggactgggccagggaagctcctcctcagctttgagctgtggctgccacccatggggctctccttccgcctctcaagatccccccagcctgacgggccgcttaccatcccctctgccctgcagagccagccgccaaggttgacctcagcttcggagccacctctggatgaactgcccccagcccccgccccattaaagacccggaagcctg

SEQ ID NO: 12910 - DNA, 595 bp, Homo sapiens
ttcggcacgaggtagagatggaagtacattttaataggatgcttcttttctcttcccccagtgcctaggttgccagagcatttgcacaaatgcccctgtttatcaataggtgactacttactacacatgaaccataatgctgcttcttgtgcatgtctgctctgatatacgtcgaacaatgtagcagccactgtcatttctcagtggttttgcctaaccaaacttcttcctaaggagatttatattctggcctacacagcagtccttgatggctgacagccacagaattccaaaccaagtagtgtctgtcagccctcttaactctgtgcacgccctatttcagtcttttacatttgttcttctagggaatgtatgcatctctatatatattttccctctcaaaaccagaacatcaacagtgctgtttctgacacttcagacatcccacgcaaagccacattgaatttttgccaaatgaaaaacacatccaacaatcaagtttctaagaaggtgtcaagtggggaataataataatgtataataatcaagaaattagtttattaaaaggaagcagaagcattgaccattttttccc

SEQ ID NO: 12911 - DNA, 798 bp, Homo sapiens
  misc_feature 484: n = A,T,C or G
gccaagaaagtgctttaatgattataaagtgtccaaaatatactggcagaaataagcggatctgagcgtttctcttcaaacctaggatatgcagggtgagagcatggcaggggctggtgggccccagggttgcctcgaggccggtcgtccagggagagcagcagcaggaagagcctcaggagatgaccctcagggatggcttgtccttctccagggcctgcagccggtcctccatctcctcagaccagtaaatgtcgtacaggaccagctgctccaggaggcagcccggctgccggacgctctccaccagctgcaggatgccggcgtcccccaggcagttgttgctgaggtccagctcacgcaggctgtggttggccaacagggttgcggcgaggctgctgcagctgctgtcactcacatcgcagtcggccaaccagagcacccgcagcacagagccaggctggcccaggccctggcacagctnccgcacgcccgcatcctccagcctgttgttgcttatctgtagctccaggagaaacctgttctgggccagcactgagctgaagtgggagcagcaggcggctgtgaagctgcaggacttcacccacagcgactccagcttgcaggcagggttccagcaggtcttacacaggagtcggggaccctcattccccaagttggtgcccggcagggtgggttctttaggttttctttgtgccgaggacacgcacacaaaccccgaaaccttgggaggagcgccacctccaaacccccggggcctgacctggatctgggtgg

SEQ ID NO: 12912 - DNA, 369 bp, Homo sapiens
tgaaaaaagtggaagcttctaccacacgtgtggcggtatcctcatcgcccccgactgggttgtgactgccggccactgcatctcgagctcctggacctaccagtggtgttgggcgattacgaccgtgctgtgaaggagggccccgagcaggtgatccccatcaactctggggacctctttgtgcatccactctggaaccgctcgtgtgtggcctgtggcaatgacatcgccctcatcaagctctcacgcagcgcccatctgggagacgccgtccagctcgcctcactccctcccgctggtgacatccttcccaacgagacaccctgctacatcaccggctggggccgtctctataccaacgggccactc

SEQ ID NO: 12913 - DNA, 340 bp, Homo sapiens
gagatcggcttctttattacagccagggcccctctggccggagccggggccggggcggggccgtgggaggtgggtgcggagccggaggtgtggagggcggggctgggctccatgggaggtcacaggcccccctaggctggccccggtcccgggttgttgagaacaccatcgatccagtctcggaagagcgccactcgggtgaagaagtcagggcctcggcacagggccccagggaaaaggaggccacgccgtgggccaggccctcgcagacgaggggtgtgccccgtccccctgggcaggcagcagctgtgtcagggcgtcccagggcctggctcccacg

SEQ ID NO: 12914 - DNA, 523 bp, Homo sapiens
cccttccccctccctgcaaatctctctgagtctctttgtgcattggaaaccagaagcagggctggtggtgtcctgggagcagtctggggagctagcatcacaaccctggttttcctctgtgtttgcttcatcttcagagtgaagactaaaacgaagaaagcagcccatccattgcaaaacacggatgatgtgaaccccgtcatggtctcatgctccacgggtcatcattaccagttgcagacaggcatactttcagaccaccctgctgaggctggccccatctcagaatatgagcaggagctccactacgctgtactacacttgcacaaggtgcaacctcaggaaccaaaggtcaccgacactgagtactcacaaatcaagatacacaagtgaagaattgtccaaagccataaccttgattggagagaacatggtacctctcagtgtattggttactagggctgccacaccaatgtaccacaaaccgagtgacataaacacagaactttattttcgtatagtt

SEQ ID NO: 12915 - DNA, 403 bp, Homo sapiens
ttgagggaaggaaacatattatttggaatcaaaggacaataatacgtcaagcaccaaatgctacaaagaaatcatgaaaataggccttaaacgagtcattcctagattaacctccccacatgtgaaaataagtcttggaagtagaaagggtgggtttggttctggtccctagagatgaaaacgtgcagtgactgcagttctgcacttctgggctggtgcgtcttttctgagtggctgttggtggctttgcacgtgaggtcacataactgcttatctcgtcaggaattttgcaagacccctggagagaaaaccagatggaccagtgggaaaggccgcccttgcaagttgctgcttcttttgttcttagtgaagatcagaaaggagcgtgaggctaggcgtggtg

SEQ ID NO: 12916 - DNA, 506 bp, Homo sapiens
ttcggcacgaggccgggactcctcccccgccaccctccgcgcatagggtccttggtctggaccctgccccccaaaatagggccttgctcctctaccttgctctgagcacggagagccctgaccccaccagtaggctcgcccccagaagggcccaagtggccgtctaccgtcaccttccagactcccgcccctaacacccagtggctacagtgcgcctgtcggggcacctggagcgctcacctggttgaattcaaagtcccagaaggccccgctggcgtgaagccggccccttacattttgcgaagtgcattatagtccttgtttttctctccctcgtgggggcaacgacccctcccctggcagtaggggtggggtaggtgactctcgctagatccctccaaagcagaccggtggcgatgtcagcggatgtcacgagctcgttagctgcgttcggggaaggttggggcgtcagggagctctcggatcacagcagcccccgccctctc

SEQ ID NO: 12917 - DNA, 497 bp, Homo sapiens
caacagcaaaacatccacaactctgtaaagctggtgggacctaatgtcaccttaattctgacttgaactggaagcattttaagaaatcttgttgcttttctaacaaattcccgcgtattttgcctttgctgctactttttctagttagatttcaaacttgcctgtggacttaataatgcaagttgcgattaattatttctggagtcatgggaacacacagcacagaaggtaggggggccctctaggtgctgaatctacacatctgtggggtctcctgggttcagcggctgttgattcaaggtcaacattgaccattggaggagtggtttaagagtgccaggcgaagggcaaactgtagatcgatctttatgctgttattacaggagaagtgacatactttatatatgtttatattagcaaggtctgtttttaataccatatactttatatttctatacatttatatttctaataatacagttatcactgatatatgt

SEQ ID NO: 12918 - DNA, 439 bp, Homo sapiens
caagtccccaaagcccgtgaagccagtggaggacgaggatgaggccgggctgcagaagtccctcaagttcaacctgatgagcgatgcccctggggacagtccccgcatccacctgcccctcaactacccaccaggcagccctgacctgggccgccactatcgctctaactccccactgccttccatccagctgcagccccagtcaccctcagcctccaagaagcaccaggtggtacaggacctgccacctgcaaacacattcgtgggcaccggggacaccacgtccacgggctctgagcagtactccgactacagctaccgcaccaacccccccaaataccccagcaagcaggtaggccagccctttcagctcagcacaccccagcccctaccccacccctaccacggagccatctggaccgaggtgtgggagtgatgg

SEQ ID NO: 12919 - DNA, 393 bp, Homo sapiens
tcctgctcaacgggaagtcctaccccggcggcagcacgcttggtttccgaggatgagagcagcttgcggatcttcctggtctcctctgtggccatgtagaacacgtcatccggggcgtcgatccagttcatccgccgccgcttgactgggggcagggagccccccggatcaggcgcactttggtggggtaggacttcccgttgagcaggaggttccggcttggtccctgcagagggggtgcacttcctgggcagccagccaagggccagctccacctcaacctgcagggctcccgctgggaggggccaccagccaaggtgctgtgcctggccaaccccccagcaccccagtgagctacacggacccccagcctggcccagggcagccctgagg

SEQ ID NO: 12920 - DNA, 528 bp, Homo sapiens
  misc_feature 425: n = A,T,C or G
ggctccaggaatcacaggctctaagggtgatatggggcctccaggagttccaggatttcaaggtccaaaaggtcttcctggcctccagggaattaaaggtgatcaaggcgatcacggcgtcccgggagctaaaggtctcccgggtcctcctggccccccaggtccttacgacatcatcaaaggggagcccgggctccctggtcctgagggccccccagggctgaaagggcttcagggactgccaggcccgaaaggccagcaaggtgttacaggattggtgggtatacctggacctccaggtattcctgggtttgacggtgcccctggccagaaaggagagatgggacctgccgggcctactggtccaagaggatttccaggtccaccaggccccgatgggttgccaggatccatggggcccccangcaccccatctgttgatcacggcttccttgtgaccaggcatagtcaaacaatagatgacccacagtgtccttctgggaccaaaattctttaccacgggtactc

SEQ ID NO: 12921 - DNA, 428 bp, Homo sapiens
tcggcacgaggcgcggtttttttttttttttttaaactttccctttttggctgccaaaccatcctcgccggccttctgcttttgggaatcaacatcgtcatcctaataattttaacctgcccgtttgcccgaacctgactaaacttcctaattttaatctccatccttttcctaaccatcaccttttttttcctcctccttttcctccccacctttttccttttttggcagtcagctactgtaaggattttgttcactgaaaataaatttggcctattctaaaacttcatataacggactcacttatgcagtatgtattctgaaagtccctttaactcaccatgttggaatgttcatcagggggttaaacctttgtccctttttatggctgaccagggttctatgtataaatgccacattttaacgtt

SEQ ID NO: 12922 - DNA, 526 bp, Homo sapiens
cacagtctgtggagcatttatttcaaccaggaggtaaccaaatctacatacagtctaaaaacggtagaaaaggtgagtaaaaaggccctcgctccatctagggtggggatggagggtggggatggagggtgggccggggcaagcgtcgtacctggcacccagagaggggctgggcagcaaggacagtgccgagtagagggaggctcgccgagcatgggacggggagggcactgccggcttgccagagcctgtccacctatgcccacggggcaggcagaaaccccgagaccaccccatgtggccagcctggctcagaaaggtccagggctggttcaggggaaaccacagcctggcctggatcctgttagcaagtccaaaccttcacagtgctatccacagcccctgagaagagtcggccccgggacacagccagcgcggtgacactgccctggtgacgcagcagggtctgcgtgcagatcatgttgtccatactccagaccctgagggaccggtcgtaagatgcact

SEQ ID NO: 12923 - DNA, 436 bp, Homo sapiens
  misc_feature 415, 421, 426, 427: n = A,T,C or G
ctcttgttaaaacagggttaaaattggtctgttgttccgcaatcaaagatgttcgaacattttgcatttcttcattctttcttttttcttgctcttcaagttgttctagaaacttagctttttcttcctgaagcttttcttgaagttcagcaactaagcttgaagaatctcctctggtagagtcaatggcaggactttttgctatttgattctcaagatgtttaactttttctaataactctttctcaacaacttctctctccaatttaaattcttttagggcagtctgaatagcttcatctttttcacaattaagcttctgaattaactgttctctgtcttgctcctggctgctgaccaatttttgtctgtctttctcaaggttctggataatagcttcgtatttctcttcttngtgggnaattnnttcatcttt

SEQ ID NO: 12924 - DNA, 547 bp, Homo sapiens
gctggcctttgtctatcctgagcttctggctggtgagttcacccgactggagttccctcggcggctgaagggggatgacttgggacagaaggttttgttcagggatcaccacatgagtggctggagctacaaacgtgtggagaaatcggatctcaagtacccactgatccatggacagggtaggcaggctcggttactaggaacactggctgtctcccggggcctgggagaccatcagctcagagtcctggacacaaacatccagctcaagcccttcttgctctctgtgccacaggtgactgtgctggatgtggaccagctggagctacaggaggatgatgtggttgtcatggcaactgatggactctgggatgtactgtccaacgagcaggtggcatggctggtgcggacttcctccctgggaaccaagaggacccacacaggttctcaaagctggcccagatgctgatacacagcacacagggaaaggaagacagtctcacagaggaagggcaggtgtcctacgatgacgtctctgtgttcgtga

SEQ ID NO: 12925 - DNA, 195 bp, Homo sapiens
tggtacgcctgcaggtaccggtccggaattcccgggtcgacatcatcatgatcgctcgacatcgatacgactttttttttttttttttttttttttggcccggggaaaaaaaaacctttttttttttttaagggggccccttttgtttttttgccaaaaccctttgggaagggggtttttgggggggggattttt

SEQ ID NO: 12926 - DNA, 166 bp, Homo sapiens; identical to SEQ ID NO: 1090

SEQ ID NO: 12927 - DNA, 449 bp, Homo sapiens
tccgcggccaggtgctggcgccgctgcccctcccggagttgctgatcatctgggctgtgatccacaaacccggttctttgtccctcctaatatcaaacagtggattgccttgctgcagaggggaaactgcacgtttaaagagaaaatatcacgggccgctttccacaatgcagttgctgtagtcatctacaataataaatccaaagaggagccagttaccatgactcatccaggcactggagatattattgctgtcatgataacagaattgaggggtaaggatattttgagttatctggagaaaaacatctctgtacaaatgacaatagctgttggaactcgaatgccaccgaagaacttcagccgtggctctctagtcttcgtgtcaatatcctttattgttttgatgattatttcttcagcatggctcatattctacttcattcaga

SEQ ID NO: 12928 - DNA, 647 bp, Homo sapiens
tggatcccccgggctgcaggaagcagatgcagcagatccgcatgtcccttcgcgggaaggctgtggtgctgatgggcaagaacaccatgatgcgcaaggccatccgagggcacctgggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagattggctacccaactgttgcatcagtaccccattctatcatcaacgggtacaa

SEQ ID NO: 12929 - DNA, 306 bp, Homo sapiens
tggatcccccgggctgcaggaattcggcacgaggaccaaatatataaataaagcacgtatcattgaccctggcccttctactaggatgattaaccctggtagggattgccgatgaaatagggacggggaccactgatcttaattaaaacccaccagttagatcatcttcatgccgttatccaaacatacctgaactaagtcgaaaagtcaattaccaacctagacaatcactgacctcgttgaatgaagtagtcctacacaaccgcagaggcctacatttgctattcctagaggatggatgtctct

SEQ ID NO: 12930 - DNA, 515 bp, Homo sapiens
  misc_feature 6, 485: n = A,T,C or G
gcgacncgccttccagagcgaggaccccgcggacccctgtgccctgctccagcgaaggcaggcccaggctgtgacagccgccagcacctgctgtccccagatgcccctgcagaagctgctcttctcagctactctgacccagaaccctgaaaagctgcagcagctgggcctccaccagccccggcttttctccacagggctagcacacaggggcctggaagatacagatggggacggggattcggggaagtatgcctttcctgttgggctcacgcaccactacgtgccctgcagcctcagctctaagccgctggtcgtcctgcacctggtcctggagatgggcttctcgagggttctctgcttcactaactcccgagagaactcccacaggctcttcctgctggtgcaagcttttgggggtgtggacgtggctgagttctcctcgcgctacggggcctggcagaaggaggatgatcctgaagcangtttgaacaggggaagattccaagctgcta

SEQ ID NO: 12931 - DNA, 447 bp, Homo sapiens
  misc_feature 237, 256, 261, 365, 405, 437, 446: n = A,T,C or G
gggagtgggaacgtgcacctcagcggtcgagctcggccgggaccctaggtgcgggggaggcggggtcccggctccgctgcctgcccagacctggcggggatggcccgtgcggctccgggtgtgggacgtatcctgggagcgcccggggttattcccactgactcccgggagtgggtgtgcgcccttcgccccctgcctggtctgtggggatccatcgttgctggagactggaggtcnggggccatgggagcccggnggcanacggtgcgggcctgggtcttgtggaaaggaggagcgaccgcctgagcttgcagcagggacgtcctcctgacctggtaataattaggttggaaggatggtttggngccgtttgcgtaactcagggaacaatggttaaaattgttncccaaacgattacagtttgattttttcccgtnagaaatttnc

SEQ ID NO: 12932 - DNA, 495 bp, Homo sapiens
  misc_feature 88: n = A,T,C or G
tcggcacgagggtgccttcaagctttattgccacacacactcccccagcccttcctgaatggccctgtgcatgggaacaccagcttanagaagcaattcagggctaggcaagggccagaggactggatttgggactggggtgggtaggggggatctggagaaggaaagtgctaagaccaaagcccacccccaccccaggtttccctgagtggtgtccacccccagggtcttgggggctggcttgtgcattggggggagggggctcatcccaaatggatcctcccctggggtctccaggctcatggagggaagataagccccactgagcccctcgcaccccccatgaagccctcaatgtgcagggagcaggaagaagagctgcacacaaacgcatacacatgcttgtctccaagagagctcctggcccctggggctgcccagccaggggctcaacagtccaaaccgatggacacgagcaggtcctcgagtgcccgc

SEQ ID NO: 12933 - DNA, 542 bp, Homo sapiens
  misc_feature 484: n = A,T,C or G
tggacctggcggtccctttctgtgtgaacttccggctgaaagggaaggacatggtggtggacatccagcggcggcacctccgggtggggctcaaggggcagccagcgatcattgatggggagctctacaatgaagtgaaggtggaggagagctcgtggctcattgaggacggcaaggtggtgactgtgcatctggagaagatcaataagatggagtggtggagccgcttggtgtccagtgaccctgagatcaacaccaagaagattaaccctgagaattccaagctgtcagacctggacagtgagactcgcagcatggtggaaaagatgatgtatgaccagcgacagaagtccatggggctgccaacttcagacgaacagaagaaacaggagattctgaagaagttcatggatcaacatccggagatggatttttccaaggctaaattcaactagcccctgttttttcctccctgaactcttgnggctgagctgcaaccacccaactttctttcccactcttctctgggacttgtgggcctc

SEQ ID NO: 12934 - DNA, 646 bp, Homo sapiens
cggcacgaggaggacctgctgcttggacccagcgagagcaatgaccgcctgtcgcagggggcatatgggggcctctcagaccgcccctcggcatccatctcccccagctctgcctccattgccgcctcccattttgactcgatggaactgcttcccccagagttgcccccccgcatccccattgaagagggacccccaacagggacagttcatcccctctcagccccctaccctcccttggacactccggaaacagccacagggtccttcctgttccagggggagccagagggcggtgagggggaccagcccctctcagggtatccttggttccacgggatgctctctcggctcaaggctgcacagttggtgctgactggcggcactggctcccacggtgtcttcctggtgcgccagagtgagacaaggcggggtgaatacgtcctcaccttcaacttccagggcaaggccatgcacctgcgtttgtcgctgaacgaagagggtcagtgccgggtccagcacctgtggttccagtccattttcgatatgctcgagcacttccgggtgcaccccatccctttggagtcgggaggctccagtgatgttgtccttgtcagctatgtcccatcctcccagcgacagcagg

SEQ ID NO: 12935 - DNA, 451 bp, Homo sapiens
tcggcacgagggcaccagtgacatttaaaggcttccgcgagtgaatgagtgcttcttaatcctaaaaacacaatggctgaattatctttctccatgtggcgctgaatcacccatctggtttggagctagagttgcttcctggtgagagaggaagcaactctccttctggttgtctgcctcccctcagatttcctgaaaggctgatggcatgtggctgtgactgtgactgtaatcattgctgaacaacatctctttgaatcaaaggttgattttcccagagggtgctgggtcaggcatttctattaggagttggaaagcaaaaatgggtccatagacactctatggaggtgtccctttctgctctttgctgtgtcctttcagaatttttaccaggaacataatgtggatgtgacttatgaacttaaatataaaataaatagattcttattat

SEQ ID NO: 12936 - DNA, 576 bp, Homo sapiens; identical to SEQ ID NO: 1943
  misc_feature 367, 490: n = A,T,C or G

SEQ ID NO: 12937 - DNA, 526 bp, Homo sapiens
  misc_feature 344, 401: n = A,T,C or G
ttcggcacgagggcctcgttctcaggccggacgctgtgtcacccctcattctggccgctgtatgaagcagcctcgggcaggggtctcaggcccgtggcccctgccacagggcactggaatggacagcaggcgcccccagatgcagggttcccggtggtgtgctgtgaagatgtcttcctctcggaccctctgctgccccgggggcagcgtgttcccctgtacctgtccaaggccccccagcagatgatgggctccctgaaactgctgccgccgccccccatcatgtctgccagggtgctcccccgcccatcaccctcccggggcccctccactgcctggctcancgggccggagctgatcgctctcactggcctgctgcagatgaaccagggggagcctangcccagctcctccgcggttggccccccagaccatacctctgacccacccagcccctgtggtagccccagcagttctcaaggtgctgacctctctctcccacagaccccagacacccattgtccat

SEQ ID NO: 12938 - DNA, 430 bp, Homo sapiens
tcggcacgaggctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctaaaatctttgtgctctcgctgcagttccctttgggttccatgttttccttgttccctcccatgcctagctggattgcagagttaagtttatgattatgaaataaaaactaaataac

SEQ ID NO: 12939 - DNA, 516 bp, Homo sapiens
tttatttgtctgtttttgtttgtttaaatatttttaaagtaggattttctttttttttttttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagatcagggattggtgatgactcttaacgagcatgctgcgttcaagcatttgtttaaccaagcacatcttgcaccgcccttaatccatttaaccctgagtggacacagcacatgtttcagagagcacagggttgggggtaaggtcacagatcaacaggatcccaaggcagaagaatttttcttagtgcagaacaaaatgaaaagtctcccatgtctacttctttctacacagacacggcaaccatccgatttctcaatcttttccccacctttcc

SEQ ID NO: 12940 - DNA, 581 bp, Homo sapiens
ttcggcacgaggaggtggacaaagggatccccagccagagagagagagaccagccaacagcttgatagaccagtgcagccagagagaccaccaaacagagcccccaaaagacagacatctctgctagctggacagccaggtggaccccctaagttagattactagacagatataaacagatcccctgctgaacagatacacagagttctcagaccccacccccaccctcaggtgggctggctggctgacagaccttctggccagacagactcctaaccaaccagatggactgccagacaggcagacatcagccacatggaatcctgacatcccagccagccggccagactctcatcttgatgtcttgatggatggaccccagctagtcagacatgatcctccagattgacagacaagtcccccaaatgagtacacatctccagctattcagacagatggacccccagcaaatcaggacctatctaggcagaccccagccagacccccgccagacagactcccaaccagactgaccccttactattcacacagcctgccgagtagctgggactacaggtcta

SEQ ID NO: 12941 - DNA, 221 bp, Homo sapiens; identical to SEQ ID NO: 1951

SEQ ID NO: 12942 - DNA, 50 bp, Homo sapiens
tcgcgcgcctgcaggtcgacacctagtggatccaaagaattcggcacgag

SEQ ID NO: 12943 - DNA, 308 bp, Homo sapiens
tcggatccatgatcctggctactgtgtgagcctgacctcaagcacaggattccagaaatggaaggatgtgccttgtgaagacaagttctcctttgtctgcaagttcaaaaactagaggcagctggaaaatacatgtctagaactgatccagcaattacaacggagtcaaaaattaaaccggaccatctctccaactcaactcaacctggacactctcttctctgctgagtttgccttgttaatcttcaatagttttacctaccccagtctttggaaccttaaataataaaaataaacatgtttccact

SEQ ID NO: 12944 - DNA, 493 bp, Homo sapiens
  misc_feature 361: n = A,T,C or G
cggcacgaggcaaaacgccattggggcagcccccgtggatggagaattgctgtggagtgtgccaaccttaacgtcatgccggatgtcaccttcaccattaacggagtcccctataccctcagcccaactgcctacaccctactggacttcgtggatggaatgcagttctgcagcagtggctttcaaggacttgacatccaccctccagctgggcccctctggatcctgggggatgtcttcattcgacagttttactcagtctttgaccgtgggaataaccgtgtgggactggccccagcagtcccctaaggaggggccttgtgtctgtgcctgcctgtctgacagaccttgaatatgttangctggggcattctttacacctacaaaaagttattttccaaaaaatgtagctgtttccagggttgcaacttgaattaagaccaaacagaacatgagcatacacacacacacacacatatacacacacacacac

SEQ ID NO: 12945 - DNA, 585 bp, Homo sapiens
  misc_feature 487, 565, 577, 579: n = A,T,C or G
gcggccgcaaccgtcaccccagctcacaatgccagcctgcacccaggcaccgttcacctggcagaccagaggccccccggagtcgtactggcaggcatccccggggccccgggcacacagcatgtcgggctgaaggatgctgcccccggggccgggatagtcccggcggcaggtctctgtgtccaccacggagactttcacctcccgcaggctgtacgggggtggcagaggctctccctcccgcgtatagccccagccggtcaccgagcaccggatcccagggcagaagtcatctgaggccttcgggaggcagacgggcaggatcccgctggtccccggctgtcctgaggggctggagtgcaggatgatctgcctcacggtggagaagtggggagacaaagtgatctccagttcccccaggtgcacctggtagtcggatgagatcagggacccggagaagcagtgggcagctgtgagcacccactgngggctgagcagtgacccgccgcacacgtgcatcctccgcaggcggaggctggcctgccatggccatgcgccggccagngcagcgtgaccncncacgat

SEQ ID NO: 12946 - DNA, 431 bp, Homo sapiens
cggcacgaggatgagctaccacagcggcagtgtcttctctgcccgtgatcgggaccccaacagcttgctcatctcctgcgctgtctcctaccgaggggcctggtggtacaggaactgccactacgccaacctcaacgggctctacgggagcacagtggaccatcaaggagtgagctggtaccactggaagggcttcgagttctcggtgcccttcacggaaatgaagctgagaccaacaaactttcgctccccatcggggggaggctgagctgctgcccacctctctcgcaccccagtatgactgccgagcactgatgggtcgccccgagagaatagccatggtccttcaccacccatccgctggacgaagccttctctgccagcgatctcgcagcactgtgtttacaggggggaggggaggggttcgtaca

SEQ ID NO: 12947 - DNA, 490 bp, Homo sapiens
tcggcacgagcgataagggagagcccggtgaaaagggcccagaggtcttcctggcttaaagggacacaatggattgcaaggtctgcctggtatcgctggtcaccatggtgatcaaggtgctcctggctccgtgggtcctgctggtcctaggggccctgctggtccttctggccctgctggaaaagatggtcgcactggacatcctggtacagttggacctgctggcattcgaggccctcagggtcaccaaggccctgctggcccccctggtccccctggccctcctggacctccaggtgtaagcggtggtggttatgactttggttacgatggagacttctacagggctgaccagcctcgctcagcaccttctctcagacccaaggactatgaagttgatgctactctgaagtctctcaacaaccagattgagacccttcttactcctgaaggctctagaaagaacccagctcgcacatgccgtgacttg

SEQ ID NO: 12948 - DNA, 455 bp, Homo sapiens
gaaccccatggtgcggcacgagtgcgcggaggccctgggcgccattgcccggcccgcctgcctggccgcgctgcaggctcacgcggacgacccagagcgcgtggtgcgtgagagctgcgaggtggctctggacatgtatgagcacgagaccgggcgggccttccagtacgcggacggcctggagcagctgcgcggggccccctcctagggcccacctctcacccggagctcccggaggactcttgagggccgctcctcccccgcagagctttggcgtctaaaccgggtgtgtgtaaataggtgtcatcgcttgtgtcttgctgggcgcacggttgctgtccccctcctccgtctgggaccgaggagctgccgttgtgctgtgactccctgagtcccctgactgctcctcggggcctggcgcagggctgtagcgtggaagtttccaggcttggggt

SEQ ID NO: 12949 - DNA, 457 bp, Homo sapiens
ttttttttttttttttttttttatttttttttctttttttttttttttttttttttttttttttttcaggattccttcaactttaattgtgggggtaaaatcaggcagccactgaagataaaatacggtccctgggagtaatcacaatgctgttttcttttgtaaagtggacataagagtagttttttttttttttattagcgcaagtggtcaaaagttgtcaaaattgtcctcattccccgattgtctcttttttaccagtctcttgcccttcaaacagaggatacctggcctccacatcagcccatgtgatgttgccattggctaggtcttggactatgctgggcagctcagaaatctctgctcttatctgccgcattgagtcacggtccctcagagttgcagtgtggggggtcttgttcactgtgtcaaagtcaatggtgacaccaaaagccac

SEQ ID NO: 12950 - DNA, 530 bp, Homo sapiens
ttcggcacgaggaaaggacttgcaacaaagcattgccagagaacctagtgctccttcaattcctacacctgcgtatcagtccttaccagcaggaggacatgcaccaactcctccaactccagcgccaagaaccatgccgcctactaagccccagcccccagccaggcctccaccacctgtgcttccagcaaatcgagctccttctgctactgctccatctccagtgggggctgggactgctgcgccagctccatcacaaacgcctggctcagctcctcctccacaggcgcagggaccaccctatcccacctatccaggatatcctgggtattgccaaatgcccatgcccatgggctataatccttatgcgtatggccagtataatatgccatatccaccagtgtatcaccagagtcctggacaggctccgtacccgggaccccagcagccttcataccccttccctcagcccccacagcagtcttactatccacagcagtaatatgtctgctcagcagctcagctgattc

SEQ ID NO: 12951 - DNA, 400 bp, Homo sapiens
  misc_feature 300, 316: n = A,T,C or G
acagcaggaggagctgatgaaggccttcgagacgcccgaggagaagcgcgcacggggctggccaagaaggaggccaaggagcgcaagaagcgggagaagatgggctggggtgaggagtacatgggctacaccaacaccgacaaccccttcggagacaacaacctgctgggcaccttcatctggaataaggccctggagaagaaggggatcagccacctggaggagaaggagctgaaggagcggaacaagaggatccaggaggacaaccggctggagctgcagaaggtgaagcagctgcgnctggagcgggaggggnagaaggccatgcgcgacaggagctggagatgctgcagcgcagaaggaggcagagcacttcaagacatgggaggagcaggaggac

SEQ ID NO: 12952 - DNA, 376 bp, Homo sapiens
cagggctggccatgtggccgagcctgctgctgctcctgctgttgccggggcccccgcccgtcgccggcttggaagacgctgccttcccccacctgggggacagcttgcagcccctgccccgggcctgtcccctgcgctgctcctgcccccgaatcgacactgtggactgtgatggcttggaccttcgagtgttcccggacaacatcaccagagccgctcagcacctctccctgcagaacaaccagctccatgaactcccctaccccaaactcccaacacagatggaggcagcaacaataaagccaaacccttccagcactgagcacggaccatgcacccttctggggctctgtccacggactcctccccacaacca

SEQ ID NO: 12953 - DNA, 498 bp, Homo sapiens
ttcggcacgaggaggatttgccagaaactgttccttacttaaaaatttttacagttggacatcaagtgcctgatgatgagactatttttaaattcaaacacgctgttaatgggtttttgaaagaaaataaagataatgataaacttattggtgtccactgtacccatggtttaaacaggactggctacctcatttgcagatatttgattgatgtagaaggcgtgaggccagatgatgcaattgaattattcaataggtgccggggacattgcttagaaagacaaaactacattgaagaccttcagaatggtcctatcagaaagaattggaattccagtgtacccaggtcaagtgattttgaagactcagcacatctcatgcaaccagtccacaataagcctgttaaacaaggacctaggtataatctacatcagatccagggtcactcagctcctcgacatttccacacccagacccaaagtttgcaacaatcagtca

SEQ ID NO: 12954 - DNA, 160 bp, Homo sapiens; identical to SEQ ID NO: 1119

SEQ ID NO: 12955 - DNA, 253 bp, Homo sapiens
tggtacgcctgcaggtaccggtccggaattcccgggtcgacatcatcatcatgatcgctcgacatcgatacgactttttttttttttttttttttttttggggggggggaaaaaaaaacccctaaaaatttttttaggagggggtttttttttttttccaaaagcccttgggaccgggggctttggggggagaaaccttggaaaccgtaagccctttttccccccccggaaaaaaaaaagggggggcccttta

SEQ ID NO: 12956 - DNA, 339 bp, Homo sapiens; identical to SEQ ID NO: 274

SEQ ID NO: 12957 - DNA, 558 bp, Homo sapiens
  misc_feature 45, 368, 436, 469, 495, 532, 553: n = A,T,C or G
tcagcattttcaaagcactttattgagttcctgcgccatcctggngaagctggccgcactgggggaatgggacacaatcttgccttccatgccccagccactctctcactgcggaatcaccaaggagggaaagatgagtccctgagcaatcaggaaacggtgtgctcccggatccaggccaggtagtaggccacatcggtgtagacgcctggcttgttgcggtcaccacagcccgatccccagctgatgatgccttgcagggtgagccggcgctctgcagcttggtcctcacacaccagcgggcctccggaatcaccctgggtcggaaacacgcagctcagcgctgtgggacctgagatttgtgcctnacggccttcggggaagggcgccaaccgggctaagagctcacctggcacgcatcggtgccgccctcgangaaccctgcgcagagatgccggggaggatggangatccgtgcacgtccggggcttaagnagcgctccagggagaggaacggtacttgggcctctgnagaaactggaatatcctccgnccctt

SEQ ID NO: 12958 - DNA, 422 bp, Homo sapiens
ccgccgcccgcctgtgtgtccccagagccatggagagagccagtctgatccagaaggccaagctggcagagcaggccgaacgctatgaggacatggcagccttcatgaaaggcgccgtggagaagggcgaggagctctcctgcgaagagcgaaacctgctctcagtagcctataagaacgtggtgggcggccagagggctgcctggagggtgctgtccagtattgagcagaaaagcaacgaggagggctcggaggagaaggggcccgaggtgcgtgagtaccgggagaaggtggagactgagctccagggcgtgtgcgacaccgtgctgggcctgctggacagccacctcatcaaggaggccggggacgccgagagccgggtcttctacctgaagatgaagggtgactactaccgctacctg

SEQ ID NO: 12959 - DNA, 380 bp, Homo sapiens
  misc_feature 3, 13, 82, 280, 303, 318, 338, 354: n = A,T,C or G
ttncggcacaggnatcgctcaccccgcagcttcctggccaagaagctgcagctggtgcgtagggtggggccccccccggtangattggcatctccccctgcaccctccccggctccaccgccatctcccccatcatcaagaacgccatctccctgccccagctcaaccaggccgcctacgacagcctcgtggttggcaagctcagcttcgacagcagccccaccagctccacggacggccactccagctacggcctggactctgggttctgcaccatctnccgcctgccccgctcggaaaagncgcatgcaccgagancgggatggttccttcccctntgaggcccgggctttngcgcttctgcactttgtcttgtcctt

SEQ ID NO: 12960 - DNA, 455 bp, Homo sapiens
tactctcaggctgcgtgcagcgacagtgcccatggctctgatgtgtctctcacagcttgaaaagcctgatacagctgtcttgtgagggactgacatgcatgatttcttcacgcctcccctttgtgacttcaagaacctctggcatctctttctgcaaaggcacctgaatgtgtctgcgtccctgttagcataatgtgacgaggtggacagacagcccacccttgtgtccactgtgacccctgttcccatgctgacctgtgtttcctccccagtcatctttcttgatccagagaggtggagctggatgtctccatctctgtctcaactttacgtgcactgaactgcaacttcttacttccctactgaaaatgagaatctgaatataaatttgttttctcaaatatttgctatgagaggctgatggattaattaagcggccgcaagcttattccctt

SEQ ID NO: 12961 - DNA, 511 bp, Homo sapiens
  misc_feature 308: n = A,T,C or G
agcctctctcttctgatggcccccacctgctccgggacggcccccttacccctgctgcttcagggtttttccccggcgggttgggaggggcaggaggtggggtggaaatagggtgggctcctttcctcaggtagagtggggggccaaaacctctgcagtccccggcagtgagctatggactttcttccccctcacaaggctgggggcctcctgctctcgtccctggccctccctgcacagggcaaagccagtctgggctctggcacacagagttcatgtttgcgccctctccctgcccctcaccccanagggtgaggaggaatgaggggcattggtggttaggccggttggctgtcttgaacagctggagggaagatgcaggggtgggaagcggccaggcagaaagagctccaggctcttgtgtcgcccacccagccctcccatactcactcctgacagctttcctgcactgcagcttcctgctcctctgactctagtgggaacaggcccc

SEQ ID NO: 12962 - DNA, 473 bp, Homo sapiens
  misc_feature 187, 200, 261, 320, 325, 424, 445, 452: n = A,T,C or G
gttctgaggttgcttttattccaagaactctgtgagctccgcccagataccattggcgcctgcttgtgtccccaggggcctacacacaacagcaccagcaccatgagggcgctctcgacccacacaagccctggtccccgtcagtcaatgtgactgagtccgccattgaggccagtctggctggccncaagtggtccctntgagtccccaactccctgggccagcaaggagtgaagctccatgccccttggtccacgcctntagagtctgaggcatatcctgcagcctcgatctcaggagggcaacgcatgcagcccccntgcantcagaaagggggtttctccagttcgtgggtttttctttctttgttccacaagtttccagatgggcccctccttgggaggcccttgcccagggagggganacgggccaaatttttcggggnagagcanaggagttcaccgttttttcgt

SEQ ID NO: 12963 - DNA, 500 bp, Homo sapiens
cggcacgaggataataagtaataaactggaacttagagcagaattaccaggatagtgggagaaatctgaaaccatatcatatggaaaatggtgaaggctctagtaatatttattccatgctgttgacaccaatttaaaagttatctttaaatacttgaagagttatgtaaagattagatttttgactcaatatacaacaaattgtaaattctattacaaaaatagaatatactgtcttataagtcctcttctattaatattattattaaaacagaactaaatggaagggtggtaattaataaagattcaagctaacgtatggggcccggcatgttggctcatgcctgtaatcccagcctgaccaacatgaggttgaagcgggcagatcacttgaggtcaggagtttgagaccagcctgaccaacatggtgaaatcccatctctactaaaaatacaaaattagctgggcatggtggtgcacgcccataatcccagctactc

SEQ ID NO: 12964 - DNA, 516 bp, Homo sapiens
cgtcgcgtacctaggatgccgcgtggaagccgaagccgcacctcccgcatggcccctccggccagccgggcccctcagatgaaagctgcacccaggccagcaccagtcgctcagccaccagcagcggcacccccatctgcagttggctcttctgctgctgcgccccggcagccaggtctgatggcccagatggcaaccactgcagctggcgtggctgtgggctctgctgtggggcacacattgggtcacgccattactgggggcttcagtggaggaagtaatgctgagcctgcgaggcctgacatcacttaccaggagcctcagggaacccagccagcacagcagcagcagccttgcctctatgagatcaaacagtttctggagtgtgcccagaaccagggtgacatcaagctctgtgagggtttcaatgaggtgctgaaacagtgccgacttgcaaacggattggcctaatgaagaagttcaacctggagagatggaaaatcagctctcataact

SEQ ID NO: 12965 - DNA, 635 bp, Homo sapiens
tcggcatgaggggcttcaggagggagcggagcagccattctccaggccccgtggttgcccctggacgtgtgcgtctgctgctccggggtggagctggggtgtgggatgcacggcctcgtgggggccgggccgtcctccagccccgctgctccctggccagcccccttgtcgctgtcggtcccgtctaaccatgatgccttaacatgtggagtgtaccgtggggcctcactaacctctaactccctgtgtctgcatgagcatgtggcctccccgtcccttccccggtggcgaacccagtgacccacggacacgtggggtgtgctgctgctgctccccagcccaccagtgcctggccagcctgcccccttccctggacagggctgtggagatggctccggcggcttggggaaagccaaattgccaaaactcaagtcacctcagtaccatccaggatgctgggtattgtcctgcctctgccttttctgtctcagcgggcagtgcccagagcccacacccccccaagagccctcgatggacagcctcacccaccccacctgggcccagccaggagccccgcctggccatcagtatttattgcctccgtccgtgccgtccctgggccactggcctggcgc

SEQ ID NO: 12966 - DNA, 434 bp, Homo sapiens
ttcggcacgagggtccctctggtggttggggatggagcggcagcaaggggtgtaatggggctgggttctgtcttctacaggccaccccgaggtcctcagtggttgcctggggagccggacggggctcctgaggggtacaggttgggtgggccctccctgagggtctggggtcaggctttggcctctgctgcctctcagtcaccaagtcacctccctctgaaaatccagtcccttctttggatgtccttgtgagtcactctgggcctggctgtcgtccctcctcagcttcttgttcctgggacaagggtcaagccaggatgggcccaggcctgggatcccccaccccaggacccccaggccccctcccctgctgctttgcggggggcagggcagaaatggactccttttgggtccccgaggtggggtcccctccc

SEQ ID NO: 12967 - DNA, 390 bp, Homo sapiens
tcggcacgaggctgacttccgagagctgtaggtgaagtgaggaccaggcagcagtccagagctgtgaggccccaggcccacaggaatggaatgaagaaagacctgttccacacaaggaggggttttctagtggaagctgagcttggaagctcctggagccaagtttaccacaggataggcaggtacagccgcccagtgtgtgcagtgtgtgcccactctggtgcttggacaagaagttcaagtccctttcacgtttacaattgtgaaaacaacaaaacaataccttcctggaaagtaggaagacaaagcagaaatgtgaattggaaatacagccaactattttacgaaaaactaattagcaagcatctgattaaacttattcagaaactg

SEQ ID NO: 12968 - DNA, 627 bp, Homo sapiens
ttcggcacgagggcctggccgagctgagcagcctgagtgtcctgcgtctcagccacaattccatcagccacattgcggagggtgccttcaagggactcatgagcctgcgagtcttggatctggaccataacgagatttcgggcacaatagatgacacgagcggcgccttctcagggctcgacagcctcagcaagctgactctgtttggaaacaagatcaagtctgtggctaagaaagcattctcggggctggaaggcctggagcacctgaaccttggagggaatgcgatcagatctgtccagtttgatgcctttgtgaagatgaagaatcttaaagagctccatatcagcagcgacagcttcctgtgtgactgccagctgaagtggctgcccccgtggctaattggcaggatgctgcaggcctttgtgacagccacctgtgcccacccagaatcactgaagggtcagagcattttctctgtgccaccagagagtttcgtgtgcgatgacttcctgaagccacagatcatcacccagccagaaaccaccatggctatggtgggcaaggacatccggtttacatgctcagcagccagcagcagcagctcccccatgacctttgcctgga

SEQ ID NO: 12969 - DNA, 618 bp, Homo sapiens; identical to SEQ ID NO: 2028
  misc_feature 85, 515: n = A,T,C or G

SEQ ID NO: 12970 - DNA, 50 bp, Homo sapiens
attcttaacctctttccctcaacaacattgctggttcctctatgctatgc

SEQ ID NO: 12971 - DNA, 508 bp, Homo sapiens
tttgtagacaaaagctttttattagctaactatatgaaaggataaacactgtaataattcatgtgattcaaaatgggcaaaagcaaaagactagcttcccctcaagaagaaaaatttcagacctatgaaaaggacaacaatactaataaaaaaaattgtatttacttagaagcattcagaatgtcaacaaaacagctgcaacttttttttttttttgcaattacagagtggtattcagttaacagaacaacaattatttcgtataagctgcatcagagacaactgaagatgaaaaaactaccatccccatatataactaatttgtgctgtgcaccaacaagaacctgctttaaatttccatgccaatttacaacccccatactgtaccaggcaaggttagtggctattgaaaataccaccaggacagggctatctaaagacacattcggtagtgtgttaactatacaaaaaaagacactgtacagtttaaaaacaaatcttacacagc

SEQ ID NO: 12972 - DNA, 589 bp, Homo sapiens
ggggccgtttccgcaaacagaatcgcgtttggctgtgctggatgtgtgaacctattgggtactgtacaacttcaagcctcgaaatcagataggcaccaccaacctcatttcctgtttcaccttgattttctgtgataccaaaatctcagcttcacaaagtcattgaaagtgttggttcatgaagttttaccatcaattcaagtaatcataaatggcaaattctgcaaaagcagaagaatatgaaaagatgtctcttgaacaggcaaaagcgtcagtgaattctgaaacagagtcttcattcaatattaatgaaaacacaacagcttctgggactgggctttctgaaaagacttctgtctgtaggcaagtagacatagcaagaaagagaaaagagtttgaagatgatcttgtaaaggaaagttctagttgtgggaaagacactccatccaagaagagaaaacttgatcctgaaattgtcccagaggaaaaagattgtggtgatgctgaaggcaattcaaagaaaagaaaaagagaaactgaggatgttccaaaagataaatcttctactggagatggcactcaaaataag

SEQ ID NO: 12973 - DNA, 499 bp, Homo sapiens
acagaagggggacaatttaggaattttaaactttagatgatcatttggttccatttttatttcatttttatttttgttaatgcaaacaggacttaaatgaactttgatctctgttttaaagattattaaaaaacattgtgtatctatacatatggctcttgaggacttagctttcactacactacaggatatgatctccatgtagtccatataaacctgcagagtgattttccagagtgctcgatactgttaattacatctccattagggctgaaaagaatgacctacgtttctgtatacagctgtgttgcttttgatgttgtgttactgtacacagaagtgtgtgcactgaggctctgcgtgtggtccgtatggaaagcctggtagccctgcgagttaagtactgcttccattcattgtttacgctggaatttttctccccatggaatgtaagtaaaacttaagtgtttgtcatcaataaatggtaatactaaatttt

SEQ ID NO: 12974 - DNA, 311 bp, Homo sapiens
gggggtttgctgccagcggcgtgagcttcggccgccattttacaacagctccactcgcgccggacacagggagcagcgagcacgcgtttcccgcaacccgataccatcggacaggatttctccgcctcagcccaacggggagatctctggaaacatggctacagaacatgttaatggaaatggtactgaacagcccatggatactacttctgcagttatccattcagaaaattttcagacattgcttgatgctggtttaccacagaaagttgctgaaaaactagatgaaatttaccttgcagggctagttg

SEQ ID NO: 12975 - DNA, 584 bp, Homo sapiens
acagaaggggagagcgccagagccgagtcagccataaagctacgcgctaggctcttggccctgacgtgaggcgcgcagagatggcgtaacgggaatagttttcaacgtctatttcattccctgcttcagaggacctctttaatctttgattttggtccctgtttctaagaaaagcaactgaaaaggtcgtaataccgcccctgagaaaaaaggagcagcgctaaataatcgagaaaatgcctcctcttgaaacggatatagagatggaaacaagatataagaaggattgagaatcatataatacaggagcttaaacacctatgcgcgatgataaagagggtactattagagcgcttggaaaataccaggaagttgagagagttaacagaagggcgcacgctggattggccacaaaatcgaattactgaaggccactactgattaggacacttatggagaacgtgggtagcactgaagcagcattctagtttccagtgccgtcaacctcatacgtatctacctggtctctgatcgaagctaccgtaatgtgttcttgaggtcaacatgttttgtggaagtcactg

SEQ ID NO: 12976 - DNA, 571 bp, Homo sapiens; identical to SEQ ID NO: 2040

SEQ ID NO: 12977 - DNA, 628 bp, Homo sapiens
  misc_feature 394: n = A,T,C or G
accatagccagtgggggtgtgttacccaacatccaccccgagttgctagcgaagaagcggggatccaaaggaaagttggaagccatcatcacaccacccccagccaaaaaggccaagtctccatcccagaagaagcctgtgtctaaaaaagcaggaggcaagaaaggggcccggaaatccaagaagaagcagggtgaagtcagtaaggcagccagcgccgacagcacaaccgagggcacacctgccgacggcttcacagtcctctccaccaagagcctattccttggccaaaagctgaaccttattcacagtgaaatcagtaatttagccggctttgaggtggaggccataatcaatcctaccaatgctgacattgaccttaaagatgacctangaaacacgctggagaagaaaggtggcaaggagtttgtggaagctgtcctggaactccggaaaaagaacgggcccttggaagtagctggagctgctgtcagcgcaggccatggcctgcctgccaagtttgtgatccactgtaatagtccagtttggggtgcagacaagtgtgaagaacttctggaaaagacagtgaaaaactgcttggccctggctgatgataagaagctgaaat

SEQ ID NO: 12978 - DNA, 529 bp, Homo sapiens
gcggaagcgttggaggacattccctgttgactgcgtcgcgatgtgtggcgactgtgtggagaaggaatatcccaaccggggtaatacctgcctggagaatggatctttcttactgaactttacaggctgtgcagtgtgcagtaagcgggattttatgctgatcacaaacaaatccttgaaagaagaagatggagaagaaatagttacctatgatcatttgtgtaagaattgtcatcatgtaatagccagacatgagtatacattcagtatcatggatgaatttcaggagtataccatgctgtgtctgttatgcggcaaagccgaagatactatcagtattctccctgatgacccccgacaaatgactctcttattctaaggatccttctacagatctgttataactatattgtgttggtttacaatacagcaagcctgatggtttgtcttatttcattcatactgaaaattctttgcatattttttttctgcttagacttacttattctttgaggaaaaaaggtaatgt

SEQ ID NO: 12979 - DNA, 614 bp, Homo sapiens
gcaggctcgcggcgggcgctgggcgcgggatccgactctagtcgtaatggaggcgggcggctttctggactcgctcatttacggagcatgcgtggtcttcacccttggcatgttctccgccggcctctcggacctcaggcacatgcgaatgacccggagtgtggacaacgtccagttcctgccctttctcaccacggaagtcaacaacctgggctggctgagttatggggctttgaagggagacgggatcctcatcgtcgtcaacacagtgggtgctgcgcttcagaccctgtatatcttggcatatctgcattactgccctcggaagcgtgttgtgctcctacagactgcaaccctgctaggggtccttctcctgggttatggctacttttggctcctggtacccaaccctgaggcccggcttcagcagttgggcctcttctgcagtgtcttcaccatcagcatgtacctctcaccactggctgacttggctaaggtgattcaaactaaatcaacccaatgtctctcctacccactcaccattgctacccttctcacctctgcctcctggtgcctctatgggtttcgactcagagatccctatatcatggtgt

SEQ ID NO: 12980 - DNA, 434 bp, Homo sapiens
atgtgtgttatttgtttccctgtttttttggtaggtcttatataaaacaaacattcctttgttctagtgttgtgaagggcctccctcttcctttatctgaagtggtgaatatagtaaatatacattctggttacactactgtaaacttgtatgtagggtgatgaccctctttgtcctaggtgtaccctttcctcatctctattaaattgtaaacaggactactgcatgtactctctttgcagtgaatttggaatggaaggccaggtttctataacttttgaacaggtactttgtgaaatgactcaatttctattgtggtaagctcattggcagcttagcattttgcaaaggaattgctttgcaggaaatatttaattttcaaaaacataatgattaatgttccaattatgcatcacttcccccagtataaatca

SEQ ID NO: 12981 - DNA, 464 bp, Homo sapiens
ggtggtcagagcgagcttcggagaagcagtggtgggttccatgtgatggtggagtaggaggcaggtctccgcggttcatctgtgttgctctaaatgacactgcttcattattttgatggctggagaatatttcctagtgtatgtatatgagagtttcttgatctctttatctgtggatgaacagctactttgaaacatatggtacatttgtgttaaggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggtcatttaccatgctgtcct

SEQ ID NO: 12982 - DNA, 145 bp, Homo sapiens
gtggacacaagcgaaatggtcaacggcgctacagaacaaaggacgaggtgtaaagagtccagccccatcccctccccgacctctgatcgtaaagccaagactgccctcccagcccagagtgccgccaccttaccagccagaaccc

SEQ ID NO: 12983 - DNA, 586 bp, Homo sapiens
gtaatctaaatggacattcaattgggcaatatagaatacatgctggaaaaacagtgccgattgtgaaaggaggggaggcaacaagaatggaggaaggagaagtatatgcaattgaaacctttggtagtacaggaaaaggtgttgttcatgatgatatggaatgttcacattacatgaaaaattttgatgttggacatgtgccaataaggcttccaagaacaaaacacttgttaaatgtcatcaatgaaaactttggaacccttgccttctgccgcagatggctggatcgcttgggagaaagtaaatacttgatggctctgaagaatctgtgtgacttgggcattgtagatccatatccaccattatgtgacattaaaggatcatatacagcgcaatttgaacataccatcctgttgcgtccaacatgtaaagaagttgtcagcagaggagatgactattaaacttagtccaaagccacctcaacacctttattttctgagctttgttggaaaacatgataccagaattaatttgccacatgttgtctgttttaacagtggacccatgtaatacttttatccatgtt

SEQ ID NO: 12984 - DNA, 254 bp, Homo sapiens
atattattcttcaacgacattttttgtaactttacacttttttggttattttattttaaaaaaatgaaaaattaatttaaaaaaatgcaaaaaactgttggattatttattttagaaattcccccctttgtgttggactgcaaattgagtttctttctctttaggcctttcacaactaggactgagaatgtatgtaaaagttctgtgacagtacagaaggaaaacaactttttatgtatagcttctaaaagggg

SEQ ID NO: 12985 - DNA, 407 bp, Homo sapiens
gcataaactgtcacctgaagagtacgtattagctgccatcagcctctacttggatatcatcaatctattcctgcacctgttacggtttctggaagcagttaataaaaagtaattaaaagtatctcagctcaactgaagaacaacaaaaaaaatttaacgagaaaaaaggattaaagtaattggaagcagtatatagaaactgtttcattaagtaataaagtttgaaacaatgattaaatactgttacaatctttatttgtatcatatgtaattttgagagctttaaaatcttactattctttatgatacctcatttctaaatccttgatttaggatctcagttaagagctatcaaaattctattaaaaatgcttttctggctgggcacagtggctcacgcctgtaat

SEQ ID NO: 12986 - DNA, 487 bp, Homo sapiens
acgacagaagggtacggctgcgagaagacgacagaagggtacggctgcgagaagacgacagaagggtacggctgcgagaagacgacagaagggtacgggtgcgagaagacgacagaagggtacggctgcgagaagacgacagaagggtacggctgcgagaagacgacagaagggtacggctgcgagaagacgacagaagggatgtgtaggccgggcatggtggctcacgcctgtaatcccagcactttgggaggccaaggcgggtgaatcacaaggtcaggagttcaagaccaacctggccaagatggtgtgaaaccccatctctactaaaaatacaaaaattagctgggcatggtggcaggcgcctataatcccacctactagggagactgaggcagagaattgcttgaacccaggaggcggaggttgcagtgagccgagcttgatcacagcactccaggctgggcgacagagcgagacttggtct

SEQ ID NO: 12987 - DNA, 587 bp, Homo sapiens
acagaagggatgcaatcatcagcgaggcctggcggctagtggaggaaggaatcgtgtctcctagtgacctggaccttgtcatgtcagaagggttgggcatgcggtatgcattcattggacccctggaaaccatgcatctcaatgcagaaggtatgttaagctactgcgacagatacagcgaaggcataaaacatgtcctacagacttttggacccattccagagttttccagggccactgctgagaaggttaaccaggacatgtgcatgaaggtccctgatgacccggagcacttagctgccaggaggcagtggagggacgagtgcctcatgagactcgccaagttgaagagtcaagtgcagccccagtgaatttcttgtaatgcagcttccactcctctcattggaggccctatttgggaacactgcaagcccttaatcagccctctgtgacataggtagcagcccacggagatcctaagctggctgtcttgtgtgcagcctgagtggggtggtgcaggccggtagtctgcccgtcactttggatcatagccctgggcctggcggcacagcagcacttgcgttctc

SEQ ID NO: 12988 - DNA, 509 bp, Homo sapiens
ctgttttgaatatagccagagaaaaaagatggagaaaaaactaggacagtgtcttctcagaaaccaccaaccttgaaggctacaagtgatgaggaagattctgttttgagtatagccagagaaaacaaggatggaagaaaaatctaggacagtgtcttctgagaaaccatcaggcttgaaggctacaagtgacgagaaagattctgttttgtatatagccagagaaaaaaaggatggagaaaaatctaggacagtgtcttctcataaacaaccagcattgaaggctatctgtgacaaggaagattctgtcccggaatatggccacggaaaaaaaggatgaacaaatatctgggacagtgtcttgtcagaaacaaccagccttgaaggctacaagtgacaagaaagattctgtttcgaatatacccacagaaataaaggatggacaacaatctggaacagtgtcttctcagaaacaaccggcctggaaggctacaagtgtcaagaaagat

SEQ ID NO: 12989 - DNA, 508 bp, Homo sapiens
gattgtatgatatatttataaatgctataaagaaatattgtgtttcatgcattcagaaatgattgttaaaattctcccaactggttcgacctttgcagatacccataacctatgttgagccttgcttaccagcaaagaatatttttaatgtggatatctaattctaaagtctgttccattagaggcaattggcacatctttctatactttatatacttttctccagtaatacatgtttactttaaaaattgttgcagtgaagaaaaacctttaactgagaaatatggaaaccgtcttaattttccattggctatgatggaattaatattgtattttaaaaatgcatattgatcactataattctaaaacaattttttaaataaaccagcaggttgctaaaagaaggcattttatctaaagttattttaataggtggtatagcagtaattgtaaatttaagagttgcttttacagttaacaatggaatatgccttctctgctatgtctg

SEQ ID NO: 12990 - DNA, 477 bp, Homo sapiens
tgcctcaatattctttatctgcctcttcctacacatcgggcgaggcctatattacggatcatttctctactcagaaacctgaaacatcggcattatcctcctgcttgcaactatagcaacagccttcataggctatgtcctcccgtgaggccaaatatcattctgaggggccacagtaattacaaacttactatccgccatcccatacattgggacagacctagttcaatgaatctgaggaggctactcagtagacagtcccaccctcacacgattctttacctttcacttcatcttgcccttcattattgcagccctagcagcactccacctcctattcttgcacgaaacgggatcaaacaaccccctaggaatcacctcccattccgataaaatcaccttccacccttactacacaatcaaagacgctatctacgtagatccagacatgataagatacattgatgagtttggaca

SEQ ID NO: 12991 - DNA, 77 bp, Homo sapiens
acagaagggcatgaagggggaaggccaggatatatacccacttttttttttttttttttgaaacaaactctcaggct

SEQ ID NO: 12992 - DNA, 419 bp, Homo sapiens
gagaacggcttccggcgggagctgtgcagctccttatcatggggacaattcatctctttcgaaaaccacaaagatccttttttggcaagttgttacgggaatttagacttgtagcagctgaccgaagggtaagttattccttaaccccaattttaattattgcacaaacaacattataacattgaagaaagataatttttaaggccaatagaaatcactcctgatcctgtcacactgttttcatttttctatgttggaaaagtatttttttagtgtaaaattgcagttgtttggtgttaagttgttttactttggtaggaagcttctgttaaagttttgattctaattctgaagtgttttaaagaaaaatggttttgtggttgctttttgttattaagttttcaaaaaattaaatggat

SEQ ID NO: 12993 - DNA, 480 bp, Homo sapiens
ggaggagagcatgagtgtgtagaggagaaaactaaagttgccaaagttagccaaggagtagaagatgggcccgacaccaagagagcaaaacttgattcttctgagacaacgatggtcaaaaagaaggtggtcttctgccctgttaaagaagccctggaggtggactggagcagtgagaaagcaaaggctgctctgaagcgcacgacctccgactactttctccttcaagtgctcttaaagttccgtacagataaaggaagagatcccagttctgatacatatgaggaagattctgagctgttgctccagatacgaaatgatgtgcttgactcactgggtattagtcctgacctgcttcctgaggactttgtcaggtactgcttctccgagatggccccagtgtgtgcggtggttggagggattttggcacaggaaattgtgaaggccctgtctcagcgggaccctcctcacaacaacttc

SEQ ID NO: 12994 - DNA, 449 bp, Homo sapiens
ggatcatagctcactgcagcctgaaactccttggcttccacctcagcctcccaaagcattgggattataggcgtgagccactgcacctggccaagtaatttcttttaggaataaaaggtacttggcattccttatttgggaagtaattacagtcttatctttttttttcttttttcttttttttaataaaatctaccagtaatttaaatgtgagctttttatgtctgtcatcattctgccccctttgcctttaaaacttacaaaaatacgtgtttgttatttgagaaagcatgtttaaaaattgcagatgagaaatattgtcgttaataattatgtactgtcttaatgtgggcacttcatttgttagtataatactagataatagcagcctagttctttaggatttgacgattcaaattttttttttgttttttgtttttgtttttttt

SEQ ID NO: 12995 - DNA, 512 bp, Homo sapiens
gattttcaagacttacactagaactgtgagaacagggtaataaataagcatatgtattaatatcacctttggtcaactcttgggtagccccaacggtagtgtaggaattaacgtaatttttcctactaaaagtattggatttgttttgagagaccacagttgaaaatcattgacatacaaagtttaaaaattgttaggttaaaaaattttaaatgcatttgaagtggttttatagaaaaataattatctaacttggtttatattgacaggttgttttcttggataagaactagacgaagagaaagggagattagtgataaatgtccaggttttcaagttgaaaagtaacaatcagtgtattacaacagatggatgtgatgtcaaattacaaatgctgaaaacgttatatgtaatcatgtagccagagtaatcatacaaggcaaagaacggaaaggcatccaaataggaaagaggctggagtgcagtggcaccatctcggctcactgcaacct

SEQ ID NO: 12996 - DNA, 325 bp, Homo sapiens
taatcccagctactcggaggctgaggcaggataatcgcttgaaaccgggagacagaggttgtggtgagccgagatcacgccattgcactccagccggggcaacaagagcaaaactccatctcaaaaaaaaaaaaaaaaaaaaaagggaaaaaaccaaccaaccaccatttttaaaccctagaaaaattttggaacttgtggaacaaaaaaggggaatttgtatttaagggggaaaaaaacccttacttttattttactggggaaaaacttgccccacagaggacttaaccccttaaaaaaaagggagggaacttgtttggctttt

SEQ ID NO: 12997 - DNA, 521 bp, Homo sapiens
gagtaagaagccagcagggctggtgctggggcttcttctcctgaaggggctgcaagagggaaggcttagccatgtcgtccttgatcagaagggtgatcagcaccgcgaaagccccaggggccattggaccctacagtcaagctgtattagtcgacaggaccatttacatttcaggacagataggcatggacccttcaagtggacagcttgtgtcaggaggggtagcagaagaagctaaacaagctcttaaaaacatgggtgaaattctgaaagctgcaggctgtgacttcactaacgtggtgaaaacaactgttcttctggctgacataaatgacttcaatactgtcaatgaaatctacaaacagtatttcaagagtaattttcctgctagagctgcttaccaagttgctgctttacccaaaggcagccgaattgaaattgaagcagtaactatccaaggaccactgacaacggcatcactataagtgggcccagtgctgtgtagtctggaattgttaaca

SEQ ID NO: 12998 - DNA, 570 bp, Homo sapiens
acagaagggctgctttccaactgcctgactgcttgttcgtctcactggtgtgagctccagcatcccctttgctcgaaatggaccccaactgctcttgcgccactggtaagggaagctctgcgccctggaatccccatttcccagccctattacagagggtctctgggtttcaggaagtcgcattttaagttctgagcgacggggactccagtacttcgttagatgctttcttcctgatcacgcccctgagagcattgccctcatccctgggcctctacgtcagagttaagaatactgaggctcaaggctgaactgctccacatcacccagttggtcatgggcctgctggctgggccccagtgctctgtccaggctctgagcaatcagtgtggttgggggtgctggaaacattgactcttcagagttcaggacagaaggttctggctcgcagtctcaatattcctgggttgtatgtgcacgtgggaccttcctggtgcggtaaaacaggagggtccttgcccttcccagcgttagtggagaggacatggggcttctgttcctctgtcctga

SEQ ID NO: 12999 - DNA, 535 bp, Homo sapiens
gacagaggggaaattgggaaaaacagtggtctaggattgcctcattgctgcatagaaaatcagcaaagcagtgcaaagccagatggtatgaatggctggatccaagcattaagaagacagaatggtccagagaagaagaggaaaaactcttgcacttggccaagttgatgccaactcagtggaggaccattgctccaatcattggaagaacagcggcccagtgcttagaacactatgaatttcttctggataaagctgcccaaagagacaatgaagaggaaacaacagatgatccacgaaaacttaaacctggagaaatagatccaaatccagaaacaaaaccagcgcggcctgatccaattgatatggatgaggatgaacttgagatgctttctgaagccagagcccgcttggctaatactcagggaaagaaggccaagaggaaagcaagagagaaacaattggaagaagcaagacgtcttgctgccctccaaaatagaagagaacttcgagcagctggcatagaaattcagaa

SEQ ID NO: 13000 - DNA, 477 bp, Homo sapiens
acagaagggggacagggctgggctcttcagaacagaagcatggatctcggaatccctgacctgctggacgcgtggctggagcccccagaggatatcttctcgacaggatccgtcctggagctgggactccactgcccccctccagaggttccgggccttcaagagagtgagcctgaagatttcttgaagcttttcattgatcccaatgaggtgtactgctcagaagcatctcctggcagtgacggtggcatctctgaggacccctgccatccagacagtccccctgcccccagggcaaccagttctcctatgctctatgaggttgtctatgaggcaggggccctggagaggatgcagggggaaactgggccaaatgtaggccttatctccatccagctagatcagtggagcccagcatttatggtgcctgattcctgcatggtcagtgagctgccctttgatgctcatgcccacatc

SEQ ID NO: 13001 - DNA, 590 bp, Homo sapiens
tacgagcccgcgggatcctcggagagtatggaacccttcccctccgctctcagccggaggccagctgcgtccagccgggctcggtcttctgaacaccgatttcaaatcaggtccccggggcccagcgtcacttagggaagtggtggcattttgtggttgctgctaaatcacggagagcagccttggcactgccggtcccaacttgatccaaggagccttgagaaggagatgagattcagtaccaggggccggccgtggctcccatcctccggaatctgcaaaatggctacttcttcagaaataatggggagagggatggcaagaggccagagatcaaggccctcgagtattaacttgagcatttgggcacaaaatagacacttttggattttcccgtcttttccaacaccaaggatgagattatcaaaagatgtgttaaattaatttgtaccggccgggcgcggtggcttacgcctgtaatcccaacactttgggaggccgaggcgggcgaatcacaaggtcatgagttcgaaaccagcctggccaatatggtgaaacccccgtctctactaaaggtacagaaattagcc

SEQ ID NO: 13002 - DNA, 186 bp, Homo sapiens
aagcttgcggccgcggtttttttttttttttttttttttttttttttggggggaacctaaaatttttttttaaaaaaaaaatggggtctttttgaaaaaaccggaaaaccttggggtttaaacctggtaaccaaactttttttttttttttaaccccgaaaagggcggaattttggggtttggggt

SEQ ID NO: 13003 - DNA, 502 bp, Homo sapiens
aagatacagttgctgggacccagccctattgattgtaattcaaaaactgaggtggggcctgatttagctccatcattggaatccattccgatttgaaactctctgggttggacagttcaagagagatcctaaagaaagcaaaatcactgtggactgaaatgagtagacaaggttttctgagcatggtgaaatatgatctgggcctcgcttgggagggctgtggccaggccttgagtccttggctcagtgggaccttctgaaacagcctccaagctgcacccctgcttcctttgcttttggatgaccccctccagcagctttggtgctgatgggaataagtcgacctgcagcggaagttcagcccaagtctcagcccagcagcctccccaaacctggccagggtctggtcatgctgccgtctctgcggttctctgtggagttgtggtttctgtaccttgaagagaacttccccttctgggacccagaaacccaatgaaccctc

SEQ ID NO: 13004 - DNA, 506 bp, Homo sapiens
atttgaccaaagagctgctggccctggattcagtggaccccgagggacgagccgatgtgcgtcaggccaggagagacggtgtcaggaaggttcagaccatcttggaaaaacttgaacagaaagccattgatgtcccaggtcaagtccaggtctatgaactccagcccagcaaccttgaagcagatcagccactgcaggcaatcatggagatgggtgccgtggcagcagacaagggcaagaaaaatgctggaaatgcagaagatccccacacagaaacccagcagccagaagccacagcagcagcgacttcaaaccccagcagcatgacagacacccctggtaacccagcagcaccgtagcctctgccctgtaaaaatcagactcggaaccgatgtgtgctttagggaattttaagttgcatgcatttcagagactttaagtcagttggtttttattagctgcttggtatgcagtaacttgggtggaggcaaaacactaataaaagg

SEQ ID NO: 13005 - DNA, 517 bp, Homo sapiens
gcttctcgcctaacgctgccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctaaaagcttctcccaaaaaagcacctggtactaagggtactgctgctgctgctgctgctgctgctgctgctgctgctgctaaagttcc

SEQ ID NO: 13006 - DNA, 519 bp, Homo sapiens
gggacaattactctacagctcagaacagcaactgctgaggctgccttgggaagaagatgatcctaaacaaagctctgatgctgggggccctcgccctgaccaccgtgatgagcccttgtggaggtgaagacattgtggctgaccacgttgcctcttacggtgtaaacttgtaccagtcttacggtccctctggccagttcacccatgaatttgatggagacgaggagttctatgtggacctggagaggaaggagactgtctggaagttgcctctgttccacagacttagatttgacccgcaatttgcactgacaaacatcgctgtgctaaaacataacttgaacatcctgattaaacgctccaactctaccgctgctaccaatgaggttcctgaggtcacagtgttttccaagtctcccgtgacactgggtcagcccaacaccctcatctgtcttgtggacaacatctttcctcctgtggtcaacatcacctggctgagcaatgggcactcagtcacag

SEQ ID NO: 13007 - DNA, 596 bp, Homo sapiens
gcatgatgggacacgagtggatccggaacatgaacctccacagcctgccgcacggccaccaccagcctttctataacgtgctggtggaggacggctcctgtcgatacgcagcccaagaaaacttggaatataacgtggagcctcaagaaatctcacaccctgacgtgggacgctatttctcagagtttactggcactcactacatcccaaacgcagagctggagatccggtatccagaagatctggagtttgtctatgaaacggtgcagaatatttacagtgcaaagaaagagaacatagatgagtaaagtctagagaggacattgcacctttgctgctgctgctatcttccaagagaacgggactccggaagaagacgtctccacggagccctcgggacctgctgcaccaggaaagccactccaccagtagtgctggttgcctcctactaagtttaaataccgtgtgctcttccccagctgcaaagacaatgttgctctccgcctacactagtgaattaatctgaaaggcactgtgtcagtggcatggcttgtatgcttgtcctgtggtgacagtttgtgacattctgtcttcat

SEQ ID NO: 13008 - DNA, 193 bp, Homo sapiens
aacagcgtgggtgagttgtgaggggcaggaagcatgtcttaatggacttaaccaattttcgtcaactattcacagtaaaatctttcaatgtacaaaatttagtaatctgataaacaataaacaaaatatttgaataggcatttttcataagacgtacaaagggcagacaggcatacgaaaaggtgctcaacat

SEQ ID NO: 13009 - DNA, 558 bp, Homo sapiens
ggctcccttcccctactcatcgcactaatttacactcacaacaccctaggctcactaaacattctactactcactctcactgcccaagaactatcaaactcctgagccaacaacttaatatgactagcttacacaatagcttttatagtaaagatacctctttacggactccacttatgactccctaaagcccatgtcgaagcccccatcgctgggtcaatagtacttgccgcagtactcttaaaactaggcggctatggtataatacgcctcacactcattctcaaccccctgacaaaacacatagcctaccccttccttgtactatccctatgaggcataattataacaagctccatctgcctacgacaaacagacctaaaatcgctcattgcatactcttcaatcagccacatagccctcgtagtaacagccattctcatccaaaccccctgaagcttcaccggcgcagtcattctcataatcgcccacgggcttacatcctcattactattctgcctagcaaactcaaactacgaacgcactcacagtcgcatc

SEQ ID NO: 13010 - DNA, 453 bp, Homo sapiens
ggcgaggcccctgcagcagcagcggcgtggtcagagcgagcttcggagaagcagtggtgggttccatgtgatggtgtagtaggaggcaggtctccgcggttcatctgtgttgctctaaatgacactgtttcattattttgatggctggagaatatttcctagtgtatgtatatgagagtttcttgatctctttatctgtggatgaacaggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggtcatttaccatgctgt

SEQ ID NO: 13011 - DNA, 594 bp, Homo sapiens
acagaagggatttagtatttcatttaactttattgtggcttttacataaacatattcagttgtacttgttttaaattgtatacaagctgtacataaaattagccaaatgaatcatttcttatatcttattcatgaaagtttgcatacagatttttgcatatatgcctttttgaatttttgctggttaacctttatcatttatctttgtaatgtgaacatgcttcagagtgtaccttttgccataacctattttaatttactttttctgaagtttggagtgataatttttagtggaagcaatttgtaatttaagttggtagttatattatatatagaaaagattttttagttaaacttctggacatgagcgtcctgtttaaatttcttgttaatatcgtgccaagcctcaaaaataggcttattccatggaacaagaattaaaaatgaataagctatcaatatataatttaagtacaagtttaggctgggcgtggtggctcacgcctgtaatcccagcactttgggaggccgaggtaggcagatcacgaggtcaagagatcaagaccagcctgaccaacgtggcgaaacctcgtc

SEQ ID NO: 13012 - DNA, 542 bp, Homo sapiens
gacagagggggtggagcgccaaagctgctaagtgcgtcagttgtggagtggcgtagacgagttaagtcctggtctgcgtggaggtcgacgactccgtcgcagactacggacctgtctgggtctcagccgccaaagaccccgtccggtaggaagtactagccggacatcatgagtggctgtcgggtattcatcgggagactaaatccagcggccagggagaaggacgtggaaagattcttcaagggatatggacggataagagatattgatctgaaaagaggctttggttttgtggaatttgaggatccaagggatgcagatgatgctgtgtatgagcttgatggaaaagaactctgtagtgaaagggttactattgaacatgctagggctcggtcacgaggtggaagaggtagaggacgatactctgaccgttttagtagtcgcagacctcgaaatgatagacgaaatgctccacctgtaagaacagaaaatcgtcttatagttgagaatttatcctcaagagtcagctggcaggatctcaa

SEQ ID NO: 13013 - DNA, 521 bp, Homo sapiens
ggggcacgcgccgctgcggtgctcaggaacagcccatggaagaatcatatgaagaggtggtgacttaggtcgtaagcaggagtggacatgtttggatttccaacagctaccctgctggactgtcatggaagatatgcccagaatgtagcgttcttcaatgtgatgactgaagcccaccacaaatatgaccactctgaggctacaggatcctcaagctgggatatccaaaattctttcagaagagagaagctggaacaaaaatccccagattcgaagacactacaggaagattcacctggagtgagacaaagggtctatgagtgccaggagtgtggaaaatccttccggcaaaaagttagtctaacgttacatgagagaatccacactggtcaaaagccttttgagtgcacccactgtggaaaaagcttcagggccaaaggcaatcttgttacacatcaacggatacacacgggagagaagccttatcagtgcagggagtgtgggaaaagcttcagtcaacg

SEQ ID NO: 13014 - DNA, 359 bp, Homo sapiens; identical to SEQ ID NO: 2119

SEQ ID NO: 13015 - DNA, 506 bp, Homo sapiens
gacttccgcttccgctggggaggtcctccatgcgcagtcatgagtcgcttcaagtttatcgatattggtatcaacttgactgaccctatgttcagaggaatttataggggggttcaaaagcatcaagatgacttacaggatgtaatagggagagctgtcgagattggtgttaaaaagtttatgattacaggtggaaatctacaagacagtaaagatgcactgcatttggcacaaacaaatggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctga

SEQ ID NO: 13016 - DNA, 355 bp, Homo sapiens
ggctgacggctgtctctggactggacagcagtggcgtccgcttttctctaaggaacccgataagaactccattttctgttgatgtggagacatagggtacctccaactttccggggtttcagaagacaattttttattgaaactggaagaccaaaataattacaagcatgttgtgctggggaaatgcgtcctttgggcagctaggtttgggtggaattgatgaagaaattgtactagagcccagaaaaagtgacttctttataaataaaagggtccgagatgtaggatgtggactcagacatactgtgtttgttctggatgatggaacagtgtacacatgtggatgtaatgatct

SEQ ID NO: 13017 - DNA, 480 bp, Homo sapiens
gcatcagggactaccatctgagccgccacattctgactcacacaggagaaaagccgtttgtttgtgcagccaatggctgtgatcaaaaattcaacacaaaatcaaacttgaagaaacattttgaacgcaaacatgaaaatcaacaaaaacaatatatatgcagttttgaagactgtaagaagacctttaagaaacatcagcagctgaaaatccatcagtgccagcataccaatgaacctctattcaagtgtacccaggaaggatgtgggaaacactttgcatcacccagcaagctgaaacgacatgccaaggcccacgagggctatgtatgtcaaaaaggatgttcctttgtggcaaaaacatggacggaacttctgaaacatgtgagagaaacccataaagaggaaatactatgtgaagtatgccggaaaacatttaaacgcaaagattaccttaagcaacacatgaaaactcatgccc

SEQ ID NO: 13018 - DNA, 567 bp, Homo sapiens
ggcttttcagtcgggcgctgagtggtttttcggatcatgtctggtggctccgcggattataacagagaacatggcggcccagagggaatggaccccgatggtgtcatcgagagcaactggaatgagattgttgataactttgatgatatgaatttaaaggagtctctccttcgtggcatctatgcttacggttttgagaagccttccgctattcagcagagagctattattccctgtattaaagggtatgatgtgattgctcaagctcagtcaggtactggcaagacagccacatttgctatttccatcctgcaacagttggagattgagttcaaggagacccaagcactagtattggcccccaccagagaactggctcaacagatccaaaaggtaattctggcacttggagactatatgggagccacttgtcatgcctgcattggtggaacaaatgttcgaaatgaaatgcaaaaactgcaggctgaagcaccacatattgttgttggtacacccgggagagtgtttgatatgttaaacagaagatacctttctccaaaatggatc

SEQ ID NO: 13019 - DNA, 389 bp, Homo sapiens
catttcttaggttttttttttggtttttttttgggttggttggtttttggtttaaaaaaaaacaggattttgttttgtttcccaggttggaacacaggggggggatcttagttaattgaaccctgaaactctttggtttccacctaaccctcccaaagctttggaattttaggcgtgacccattgcccctggccaagtatttttttttaggaataaaaggtccttggctttcttttttgggaaagaaataacagcctaaccttttttttcctttttcctttttttaaaaaaaacctcccagtatttaaaaggggacctttttatgttggcaatattttggcccctttggcttttaaaatttacaaaaatccgggttggtttttggaaaa

SEQ ID NO: 13020 - DNA, 605 bp, Homo sapiens
gacagaaggattctttatctgcctcttcctacacatcgggcgaggcctatattacggatcatttctctactcagaaacctgaaacatcggcattatcctcctgcttgcaactatagcaacagccttcataggctatgtcctcccgtgaggccaaatatcattctgaggggccacagtaattacaaacttactatccgccatcccatacattgggacagacctagttcaatgaatctgaggaggctactcagtagacagtcccaccctcacacgattctttacctttcacttcatcttgcccttcattattgcagccctagcagcactccacctcctattcttgcacgaaacgggatcaaacaaccccctaggaatcacctcccattccgataaaatcaccttccacccttactacacaatcaaagacgccctcggcttacttctcttccttctctccttaatgacattaacactattctcaccagacctcctaggcgacccagacaattataccctagccaaccccttaaacacccctccccacatcaagcccgaatgatatttcctattcgcctacacaattctccgatccgtccctaacaact

SEQ ID NO: 13021 - DNA, 447 bp, Homo sapiens
ggtggaaactttggtggaagaggaggctatggtggtggaggtggtggcagcagaggtagttatggaggaggtgatggtggatataatggatttggaggtgatggtggcaactatggcggtggtcctggttatagtagtagagggggctacggtggtggtggaccaggatatggaaaccaaggtggtggatatggtggaggtggaggatatgatggttacaatgaaggaggaaattttggcggtggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaagggctacagttctt

SEQ ID NO: 13022 - DNA, 365 bp, Homo sapiens
cactttgggaggccgaggtgggtggatcacaaggtcaggagttcgagaccagcctggccaatatggtgaaaccccgtctcttctaaaaaaatacaaaaattagccgggtatggtggcgcatgcctgtagtcccagctactggggaggctgaggcaagaaaattgcttgaactcgggaggcggaggtcgcagtgagccgagatcgtgccactgcactccagcctgggtgacagagtgagactttgtctcaaagaaaaaaaaacaataataggtaaagtatttaaggaattctcagatgccttatggacctcttcaaaaatgtggttagccaattgattcaacttttataggtttatatgctctcat

SEQ ID NO: 13023 - DNA, 489 bp, Homo sapiens; identical to SEQ ID NO: 2130

SEQ ID NO: 13024 - DNA, 523 bp, Homo sapiens
taagcgaatagctaaagaaaggcaaaagcagtataactgcctgacacagcggattgaacgagagaagaaattgttcgttattgctcagaaaattcaaacacgcaaagatcttatggataaaactcagaaagtgaaggtgaagaaagaaacggtgaactccccagctatttataaatttcagagtcgtcgaaaacgttgacgtgttatagataagccttgtcattctgtatcaaaaatctgttgtcgttttctagtaacttcaaattccattactccaaatggcatggttttccggtttgtaaccataactaaattgtcagtctgacatttaatgtctttctatggacaacattaaatctccctcccttctgtaattgtttttggattgtgaaattagtcttatttttatatacttaattttttttttctttgagatagggtctttgttgccaggctggaagtgcagtgtgtgattatggctcactgcaactttgaactcctgggctcaagtgatcttcctgca

SEQ ID NO: 13025 - DNA, 626 bp, Homo sapiens
ggaccccccagcaagtcgttttgtgtctccttggactgagttaagttacaagcctttcttatacctgtctttgacaaagaagacgggattgtctttacataaaaccagcctgctcctggagcttccctggactcaacttcctaaaggcatgtgaggaaggggtagattccacaatctaatccgggtgccatcagagtagagggagtagagaatggatgttgggtaggccatcaataaggtccattctgcgcagtatctcaactgccgttcaacaatcgcaagaggaaggtggagcaggtttcttcatcttacagttgagaaaacagagactcagaagggcttcttagttcatgtttcccttagcgcctcagtgattttttcatggtggcttaggccaaaagaaatatctaaccattcaatttataaataattaggtccccaacgaattaaatattatgtcctaccaacttattagctgcttgaaaaaataatacacataaataaaaaaatatatttttcatttctatttcattgttaatcacaactacttactaaggagatgtatgcacctattggacactgtgcaacttctcacctggaatgagattggacactgctgccctcat

SEQ ID NO: 13026 - DNA, 72 bp, Homo sapiens
gcttttacctcgttgcactgctgagagcaagatgggtcaccagcagctgtactggagccacccgcgaaaatt

SEQ ID NO: 13027 - DNA, 522 bp, Homo sapiens
aacaatttcaagaacctttattgaaaccaacattcaaataatatctcaagggtgaaatgtttcagcaaaaccaatttaacaattccaaatatatataaaaacatgtaattttcttgaaggtgataatttacccctcccccattttatctgctatacttcattgcaccaaatagggaagactgtttaatcatctgcaccaaaaaaaaccccctgcattttgacaagtgtaaatgtcaaaaatcccatcaaatcagagtataattataggcttaatatactataactaaggcttccaatactacagtccagaaacccagtgtgaattttcccattttcaggtctcccaaaagcttgactgctggattaagaaggcacaggggccattacttacgacaaagtgacgcagtacttcggaaaagtaggaacgggcagtgccagcgagcttctactgacttaagcagggtgcccggctggatcagcgtgagagagtgctctgctggctcctgtttctgagttgggccc

SEQ ID NO: 13028 - DNA, 620 bp, Homo sapiens
agggaacttaggctgcggaactatgtcccggaggatgaggacctgaagaagaggagggtgccccaggccaaaccggttgcagtggaggagaaggtgaaggagcagctggaggccgccaagcccgagcccgtcatcgaggaggtggacctggccaacctcgctcctcggaagcctgactgggacctcaagagagatgtggccaagaagctggagaaactaaaaaagcggactcagagggccattgccgagctgatccgtgaaaggctgaaaggccaggaagacagcctagcctctgcagtggatgctgccaccgaacaaaagacctgtgactccgactgaggcatgccctgccccaccactcgcccatcaggcctgtcctgcagaggatggtcttgggcagggatgggggctaggcttgccatcacctccagtttggcttctgagcagagactccctgcccatcaagtctgaaacccccatggatgaggtcagctccttgtctgctgggtggcccctgccattctgaatggaggcagaaccagcaacaactctgggcgtgcctgtgtctgcacatgtggatgtacatatgtctgtatatatgtatatattttgaactttct

SEQ ID NO: 13029 - DNA, 486 bp, Homo sapiens
ccatctgtcttcatcttcccggcatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagagggagaagtgcccccacctgctcctcagttccagcctgaccccctcccatcctttggcctctgaccctttttccacaggggacctacccctattgcggtcctccagctcatctttcacctcacccccctcctcctccttggctttaattatgctaatgttggaggagaatgaataa

SEQ ID NO: 13030 - DNA, 483 bp, Homo sapiens; identical to SEQ ID NO: 2139

SEQ ID NO: 13031 - DNA, 142 bp, Homo sapiens
gttattacctctgtttacacatgaaaacactgaggctcagagatgttaagtaacttggccagagtgctacagctggtaaacttgaacttgagactagaagccaggtcttatcccaacatggctatttctctgcagctttgga

SEQ ID NO: 13032 - DNA, 341 bp, Homo sapiens
acgacagaagggtacggctgcgagaagacgacagaagggtacggctgcgagaagacgacagaagggtacggctggcgagaagacgacagaagggttcggctgcgagaggacgacagaagggtacggctgcgagaagactacagaagggtacggctgcgagaagactacagaagggtacggctgcgagaagacgacagaagggtacggctgcgagaagacgacagaagggtacggctgcgagaagactacagaagggttcggctgcgagaagacgacagaagggtacggctgcgagaagacgacagaagggtacggctgcgagaagacgacagaagggttcg

SEQ ID NO: 13033 - DNA, 592 bp, Homo sapiens
  misc_feature 529: n = A,T,C or G
ggttttgattgatgttttctgaggccctagaggagtttgtatcaatttgtgagtattaatgtcagtactaccagcactttgccaaaactgtcagagggacccgtttctagagtgagtcccagttacatcaaacagtgacttccagttattccccagtaagtctgagtggttccttcaagctgggtgtctttccagcctttgccagtctagccccagcagggcaccgtgtatgaatgcagtttggtgctgttttagagtatgcctgctccccagccccctgcctggaaccctctgagcaacttgctctgacctataatgtcttaggtgcaacacggaccccaccagagctcttggatacccccctagatccatgtggctttatgtgaggggactgaatgcagacacgccatagcccccttctactactttccctctcgccctgccacctagttccacatggaaccaacaagttgagtgcatccctgttgggcgttttgtgttgagactggctgaaatgaggagactttgnaccatgtgacgtgtcaacagactcaaggagacaaccacctcaactgggtcatgtggcatgcct

SEQ ID NO: 13034 - DNA, 570 bp, Homo sapiens
acagaaggggtataaatatcatgcacagtgttcaactgtaattcaaaaattaccagtgatggatacagaaaaatgtgacatgtaattttttttaaaagtccatggaaatagattcctcgatgattcagaagttgtagacaaggactttaaagcagaaattataaatatattcaggattttaaaaaaatatgttttcaggcccggtgcggtagctcacgcctataatccaccagatgtggtggcgtatgcttataatcccagctactcagaaggctgaggcatgagaatagatagcttgaacccaggaggtggaggttgcagtgagccgagattgctccactgcactctagcctgggcaacagagtgagaccctgtctctaaaaatatatgtatatatatagtcataatgagggaacagatgagaaaataagcagagaaatgaaaattttcaaaaataagtaaaaagttaaggtataatacctgaaatttttttgaagagtcattgaagtggcttacaatagattgtagatggcagaagaaagtgtcagtaaacttgaatacaggtcaata

SEQ ID NO: 13035 - DNA, 479 bp, Homo sapiens
aagctttgggtgggctctggcatcagcactttcactaagcttcacagataattctgatgcatactccaggcctgaaccactgatcaatttgaaacatgcataacaaagcaaaaaaagttttgtttcaccttttgaaatacagttaactcttttaccatgccagagatcattcagagagacaggtcgttgctccggagtgatacagatctggcagtacccagcccttgtgtgtgtgcgttagctcagcacctgcccacactgcgagcccccgtaggatgtgccttgtccttccctgtttcagcacttaacacactacctggtacagagtatgtagtgggcatctgttgaatgaatgcttttcccagtagcagtgtattcatacaatattaatataattgtcccctggcttacagataaaaatgaaagcatcaagtgcccagtgagtgagacccaggtgttcttcctccacccctagtggt

SEQ ID NO: 13036 - DNA, 411 bp, Homo sapiens
acagtatcttgttgcaagtccaaatcaggggagactttgttaatatgtatcttttgctcaaatttagtagggttttttttttttggattaagggcttttcaaatttggaatttgtaaaacccatttaaaaaaatacccttcctaaaaaccaaattgacacagctggcccccctgctagccaacccgcagttcccagttcccacctgctgaaagttcaaaactcaaaccgtaggtgggggcttatgaaactgtgcttcatgaaaaaaagcaaatttccaaattcaaactgttggagggagccaaggggacaaaccctccatgagtgcactttcttccaaaaaatccccagatttaccccatagaggtctgggattacctggaatataatatgaaaaacattttttaggctgg

SEQ ID NO: 13037 - DNA, 629 bp, Homo sapiens
atagctgctactggaacactattatgacctaatttatgagccatccttactcatctacaagtgctgaagcaatgttacatacttttttgctaaactcagattttttagcctaatttcttgtcctcctatccacctgcatccacacatggcctgcatggggctgccttccctgcagtgttctacagccatgcttcagggtatagctgttggtggacagcctcaggtcttgggggcactatagccactaaacgaggtgtgaaaggctcaagaggatgaccagcaattaattatccccagaaagtgaaggaaaagagacctttagggatgttgctggtcaagtcttgatttgaccggagtcaaatcaatcttcaagcaatcttggaatcctcaactgcagtaagcatttcaaaatgcaaacaaactgcttaacaactgacaagacaccagcccatacgctgctcttccacagtgggttctagctttgaacaaaagtgctaaacatttccttgaatatattcttcctctttttgtcctcatcactcaatactggtgctcttgtcacaggtagaacagcttgtttcttttccatctattcaagtgtgtttctaattctaaatgctgatcttctc

SEQ ID NO: 13038 - DNA, 572 bp, Homo sapiens; identical to SEQ ID NO: 2152

SEQ ID NO: 13039 - DNA, 236 bp, Homo sapiens
gcacaaaatactgaaggtgaaatccactgattgcaatgcaatgggacaatatatctggaagcaattttatccaaaaaaatcaatagctttaaaacaattcacaaccttggacctaatacctctacttctaggaagctagcctatgaaggtttctgctgaaggatgtttatcacagtattatttataatgtgaaaaagccaaaaaggagacctaaaatgtttcaaaaataaaaatgg

SEQ ID NO: 13040 - DNA, 383 bp, Homo sapiens
aaattcctgagcggtgctctgccaacttttcaaggggagggatttggatggctgtgttactgcacactggatctggaattgttcagggttatgagtgacaaatttcttaaacaccagcagcactgagatgtgcactatgggcattcgtacagttgttgtccaaatgcaaacaactttttcatcttggagaagctgagatacagagttcaatagaactacttggaatattttgagaaggttgaatgtttcatctttggctttgttgtctctggagtggggaagtatggagggcttttttttttttaaagagagtgtgtatgtactttttctctctataagggccagggtgttggtcaaattcaccatcgattaatttatatctt

SEQ ID NO: 13041 - DNA, 553 bp, Homo sapiens
gtgggttggtgtttgcactccaaagagttgctgtgatttccctgtatctgtctttctggcttgttagatcttctcatttggcgtcctttctccgaagagttaaccaagacgtttggcatggtttccttgctttcctcctatcttttgctgctagagctgctttcgaaaagaagtcttttcttgcagtggtatcttttctttgggttacagtgttgttcatcctttctttgccgaaagaatgaatcccagtgcttcacgaggttaaaggaaagatctgctggtagtgtttagtctttgttctgagctgatattgttagtagctttttgtttttaaattttattagtaaaatttcaccagtgaaccagaagctctttttttctgttgtgaaatgctagctttaagatttctagaactttgtgtcaaagaaatctttgaaaagttactgaagtatacagagaggttcacaattttaaatgtgcaggtggtccgggcgcggtagatcacacctgtaatcccagcactttgggacgccaaggtgggcggatcacttga

SEQ ID NO: 13042 - DNA, 426 bp, Homo sapiens
gtggatcagacagtctaaagatcctaaaaacttgccaactggatctttgtttagcaaactcactggaaatgaacacttaatggaatttttaagtctgttctgttaggtagatggtgatgctcttgttattttcacttattcagactggattacttcttacttagttactaactcaatgaggaaaaatccctacaggatctttttttgcaaacaactgatatatgcagacaaatttttgacaaattcaccttttaaacacacttaaccatttgtgaaggttttctttagcttacattttaaacatacacaataaacactaatcctccaaactttcactgtttttattagtatgaatataaaatttgaaggtttggccaattagtacaagtctcatgatataatcactgcctgcatacatatgcacag

SEQ ID NO: 13043 - DNA, 383 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaatacgacagaagggtacggctgcgagaagacgacagaaggggaatg

SEQ ID NO: 13044 - DNA, 543 bp, Homo sapiens
actgtctttaagctgttggccattgccatggtggcattaattcctggaaccctcattaaaaaatttagtcagaaacatctgcaattgaatgaaacaagtactgctaatcatatacacagtagaaaagacacatgatctggattttctgtttgccacatccctggactcagttgcttatttgtgtaatggatgtggtcctctaaagcccctcattgtttttgattgccttctataggtgatgtggacactgtgcatcaatgtgcagtgtcttttcagaaaggacgctctgctcttgaaggtgtattacatcaggttttcaaaccagccctggtgtagcagacactgcaacagatgcctcctagaaaatgctgtttgtggccgggcgcggtggctcacgcctgtaatcccagcactttgggaggccgaggccggtgattcacaaggtcaggagttcaagaccagcctggccaagatggtgaaatcctgtctctaataaaaatacaaaaattaagccaggcgtggtggcaggcacctgtaatccca

SEQ ID NO: 13045 - DNA, 551 bp, Homo sapiens
ggcccggaagaagcgaccaaagcgcctgaggaccggcaacatggtgcggtcggggaataaggcagctgttgtgctgtgtatggacgtgggctttaccatgagtaactccattcctggtatagaatccccatttgaacaagcaaagaaggtgataaccatgtttgtacagcgacaggtgtttgctgagaacaaggatgagattgctttagtcctgtttggtacagatggcactgacaatcccctttctggtggggatcagtatcagaacatcacagtgcacagacatctgatgctaccagattttgatttgctggaggacattgaaagcaaaatccaaccaggttctcaacaggctgacttcctggatgcactaatcgtgagcatggatgtgattcaacatgaaacaataggaaagaagtttgagaagaggcatattgaaatattcactgacctcagcagccgattcagcaaaagtcagctggatattataattcatagcttgaagaaatgtgacatctccctgcaattcttcttgcctttctcacttggca

SEQ ID NO: 13046 - DNA, 544 bp, Homo sapiens
ggcgcagtcccccttgaacgcacctcaggcattgaaaaggggtcggaagtgaatggagtaaacacctgacagcagcgagctgggattgagaacaaaagagcacacacaggacaatagaaaaatctgaaaaacaagtggttctcctcttctggactttgaggttataaggaggctgactaaaaacttgggtttacattaatgtcttcagatggcccgtactttggaaccactagcaaagaagatctttaaaggagttttggtagccgaacttgtaggcgtttttggagcatattttttgtttagcaagatgcacacaagccaagatttcaggcaaacaatgagcaagaaatatcccttcatcttggaagtttattacaaatccactgagaagtctggaatgtatggaatcagagagctagatcaaaaaacatggttgaacagcaaaaattaaatagtctcgctttgtcgccaggctggagtacaggggcgtgatctcggctcactgcaacctctgccttctgggttcaagcgattctcctgcctc

SEQ ID NO: 13047 - DNA, 611 bp, Homo sapiens
acagagggggctcactgcagcctctacctcccaggttcaagtgattatcctgccttagcctcctgagtagctgggattacgggcgcgtgccaccacgcccagctaattttttgtatttttagttgagacagggtttcactgtcccttaagaccatcctgttagccaagatggtcttgatctcctgacctcgtgatccgcctgcctcggcctcccagagtgctgggattacaggtgtgagccaccgtgcccagccaaagactgctcttaaagcacctttttgacagtgaacatggtctaaaaaagggaagatattgtagaagatttcacacacacacgcgtgtgtgggagacaactaaaggtattgaaggtactaattaattagatttccaaaattttctacagagagttaattatcaccaaaatgtgaatggtacatacaaaacctggcattttcttgtgataagtttacatttttaggagagtggagctttcaatctgcccttttctcctttgtttttgtagttttcaccaaagatgatcaactagaaatgttaagtggctatgcaagcaaaagcatagataggttaaaaaaaaggatcagctggctggc

SEQ ID NO: 13048 - DNA, 507 bp, Homo sapiens
ggggggacggagggttgatgtcatagcaagattgcagccttcactagattaatgaggccaggttggatcctgtttaagagaactggagacaggaagcagcgggggaatagatggggaaagaggaaagttccttatgatgcaagatgaatagtgtgtgtgtccagccccagtgctgtgacggggatgagtctgaggtggacggatgatgcaatataggagagaataaagcaggtcttcgagctagattgacagaagactgtattttttattttgttttattgaggggaggagcctgaagtgtattttatcattagtctgtcttatactgtaaataaaaatgaaagcaccagctggtaaagttttcaaataaagacataaataaggtttgatatgactcagtgtggtatgttccttctcttcctaggaaactgaaaaacagagtagcagctcagactgccagagatcgaaagaatgctcgaatgagtgagctggaacagcaagtggtag

SEQ ID NO: 13049 - DNA, 546 bp, Homo sapiens
gacagaggggggacttggcggcagaggcagtgcggatccggcgttctccactgatcttttccaaggctgtacagacatggcggcggcttttcggaaggcggctaagtcccggcagcgggaacacagagagcgaagccagcctggctttcgaaaacatctgggcctgctggagaaaaagaaagattataaacttcgtgcagatgactaccgtaaaaaacaagaatacctcaaagctcttcggaagaaggctcttgaaaaaaatccagatgaattctactacaaaatgactcgggttaaactccaggatggagtacatattattaaggagactaaggaagaagtaaccccagaacaactaaagctgatgagaactcaggacgtcaaatatatagaaatgaagagggttgcagaagctaagaaaatcgaaagactaaaatcagagctccatctgctggatttccagtggaagcaacagaacaagcatgtgttcttttttgacaccaaaaggaagttgaacagtttgatgtcgcaactcacctgcaaaca

SEQ ID NO: 13050 - DNA, 346 bp, Homo sapiens
gtggagaaggtggaaaaggtggtgatgtctgggttgtagcccaaaacagaatgactttaaaacaacttaaagacaggtatcctcggaaacggtttgtggctggagtaggagcaaacagcaaaattagtgcactgaaaggctccaaaggaaaagactgggaaatccctgtgcctgtgggtatttcagtaactgatgaaaatggtaaaattataggagaactcagtaaagaaaatgacagaattttggtagctcaaggaggtcttggtggtaaattacttacaaatttcttaccattgaaaggccagaaacgaataattcaccttgatctaaaacttatagctgatgt

SEQ ID NO: 13051 - DNA, 638 bp, Homo sapiens
acagaagggatatgcaacttgcctcatatttctgttgaacggtattagacttgacttgcgatcttgacaaaggcagggacttctctttcctgtttgccagtacacccagtgcctagtgtggtgtctgacacatagtagctgcctaatatacatctgtgggacagataaatgactcagtttacttgtgtggtttctgttcactcataacactggtttatacctgaactttgccttaagactcctcaactaaccagcaaattctctttaatatttcttagttcaggttctagtttaatctcctcatttctttaccttaattgtgtataatcagcttttcttaaaagtaaggtggaagtttttgacagaattctattgcctgagtggtaatccttcccagcacatgaatttgtcacattagtctctcctagctttgagaatttgatctattttaagaaatgtcctggctgggctcagtggctcacacctgtcatcttagacctttgggaggccgaggtgggcggatcacctgaggtcagaagttcgagaccagcctggacaacatggtgaaaccctgcctctactaaaaatacaaaaattagctgggcatggcggcgggcacctgtaatcccagctactca

SEQ ID NO: 13052 - DNA, 490 bp, Homo sapiens
aaacccagggaccatcaaagtgggagaccctgtgtacctgctgggccagtaatgggaaccgtatgtcctggaatattagatgccttttaaaaatgttctcaaaaatgacaacacttgaagcgtggtgtttcagaactgagacctctacattttctttaaatttttgattttcacatttttcgtcttttggacttctggtgtctcaatgcttcaatgtcccagtgcaaaaagtaaagaaatatagtctcaataacttagtaggacttcagtaagtcacttaaatgacaagacaggattctgaaaactccccgtttaactgattatggaatagttctttctcctgcttctccgtttatctaccaagagcgcagacttgcatcctgtcactaccactcgttagagaaagagaagaagagaaagaggaagagtgggtgggctggaagaatatcctagaatgtgttattgcccctgttcatgaggtacgcaatga

SEQ ID NO: 13053 - DNA, 589 bp, Homo sapiens
gttggagaagttcatggtatgtagtttaatgcaaaatgaaaccattttatttcaatgttattaaaaaggtttgttttattaggaagttaatgtattgttgcagtgttttgtgcctgtttaaaggcttttgtttagcagagtgaatgtaaaatacagtaaaatgttaagattgtcatctactttttaaaaaaaaatatcaacttggaattgttttttaaaggctcaatcaaggaagtgaggtgtgcaataaggtagcaagtaaaacgcagttgcgtttttatgtcatgttagagatccatacaattttccactcacgggatttttgttgatggctgaattcttgtggattcataagaggatcatgcccttagcaagtacttttgttttgttttaaattaagagattcccaaatgcctttttccccctcatcttgaaatgagatgagttttatgtgtaagcaatatttatttaactattctataaaattattgagtgcctactgaggcctttaagcaccgctaacattcctttccatcattcttttaaatgacataaaataattgtgcaatgttcctgatgatgtacccca

SEQ ID NO: 13054 - DNA, 605 bp, Homo sapiens
acagaaggggttactttattattgtattcaaaattcattgtgtatattactacaaagacaaccccaaaccaatttttttcctgcgaagtttaatgatccacaagtgtatatatgaaattctcctccttccttgcccccctctctttcttccctctttcccctccagacattctagtttgtggagggttatttaaaaaaacaaaaaaggaagatggtcaagtttgtaaaatatttgtttgtgctttttccccctccttacctgaccccctacgagtttacaggtctgtggcaatactcttaaccataagaattgaaatggtgaagaaacaagtatacactagaggctcttaaaagtattgaaagacaatactgctgttatatagcaagacataaacagattataaacatcagagccatttgcttctcagtttacatttctgatacatgcagatagcagatgtctttaaatgaaatacatgtatattgtgtatggacttaattatgcacatgctcagatgtgtagacatcctccgtatatttacataacatatagaggtaatagataggtgatatacatgatacattctcaagagttgcttgaccga

SEQ ID NO: 13055 - DNA, 542 bp, Homo sapiens
atgtacgtgccctgctgggggccttactttatagaatgagagcatccgagcttccctaatgaatctggctagttctgtgtctggctgaggatacaggagtgggacatccactctcggatccctcagagcacagaaaccttcagctttgctgtctctgaagtatttcctccagtttccctgcgggcccctatgtttgagtttgatggctgctggatcctcactcaacgaaaactcggttggaaactgttccgcctggcagtccttttttgttgttttccatctcatttcccttccatctgaaagtggcattcagctgacttgctcatttagactgttcacggagtctgaatctgccaacgtggtgttggaggctccaccttgaaaagggccacagtcagggcaactttccccatacaggaaaacttgaaaattacatcaacagtctacgtcacagccaaattatatttcctttataccaaacaaaactatggagaactaaaagtacatcacacaaaacgtttatagtgttttgcatgtgacct

SEQ ID NO: 13056 - DNA, 617 bp, Homo sapiens
cactatagggaatttggccctcgaggccaagaattcggcacgagggggagcgaaagtcctccactcagaggcagagactgagttaagtcataggtggccttaggcatctgcattgtttgcaggggttaagttttccttccagtgagggctggagggatgaattagctggtacctgaagccccgcttagctctgacactctgccaacatcctctgattctaggtgtggtgttgactgtcctttcaaggaaaaacttgcaatagagggaaaagccattaaagcagctccctgcttcatcattaagtcctgtcatccctaccagccaatcccagtcaaagaagttatgctttattcacttctgtggaattacaagtgagagacacttttaggacctgatggacaaagcaggagattcactgtcagctttcctggtcctctccttacttctgtgggccttgcaccgtcttagtttacacatctgccaaaggggtagaattacacttctttttacaggtaaatgtcaaggcacaatcagttttcaggaagtgcttcaagaccccaggtgaaatgaaaatgctaagtaccctctgaatggccatgcctgttaccaggtgctgc

SEQ ID NO: 13057 - DNA, 503 bp, Homo sapiens
agctattatgatcattttatttttgtgattattccccacctctaagtctctcagaggataaaagcctgtctgccagtctcctccggccccagttagtcatcttcccatcttccttcagtctcacttagagtccttatgctgcaatctaggtcaccctcccccaacacacacacacacacacacacacaggtcagcagggcctcagacacagaaaaaagtttaattctgctgcggcggagggtcccggctccggtagagagggggatttggttttggattttgttcgtgtggggatttatttgggagagtctggtccttccagtgggacctgcccgggagaatgagtaaagagaagaaatcaggagagacagggagactagacaaaaccagggagggccgagggacaagagacgacaggacagagagaaaggagaggcaaatagggaaagacaggcactacagagagacgacaagagggcgggatagagacaaacgagggaaac

SEQ ID NO: 13058 - DNA, 81 bp, Homo sapiens
agagtaaaaccttttatgacaggggctgcagaacaaatcaagcacatccttgctaatttcaaaactaccagttctttattg

SEQ ID NO: 13059 - DNA, 563 bp, Homo sapiens
gacagaaggggaaatttgcctctcttgggactctccccctcccaggcattttccattcctggaaaggctcctttggggttcagaatccagagaccaaaccctgacccacctccttcctttcctccagcccacgctggtcggtccccatgccttcccagggcttcttcatgtcagatgcacccaagtccttagcccagctgtgccacctgcaggagttcgctcttgcgtttcttcccctccccaagaagggagggggctacttcaggcccttctgtgtgttgcctggcaggataccttgtccaaccagctacccacctcaactcccctgtagtttaggacacaaaacagctaccagcggtacagagcggtgatcaaagccgagtacttacaactctggtaagcctagcttctccgcctcagcccttctgcttctggaagggctatcctgggggtgaacttgaaactttcatcaggcttctgcaaaagctcttcttcctgaagacagacccagcctttgtgctctcaccctccactctggtaaagctgcacctctgggggaatga

SEQ ID NO: 13060 - DNA, 496 bp, Homo sapiens
tgtgaagattgtacactatattacatgatcagatcatacaaataatctaagattatacagtctagtgatcctagattacacaagtaatctaagcttccactttaggaaactagaaaaagaagagcaaattaaatccaaagtaacctgaaaaaacattagagtagaaatcattgaaattgaaaagagaaaatcgataaaacccaaaactggttccttgaaaaggtcagtaaaattgataaacctctagctagcttaagaacaaacagaagacaaatattgctaataccaaaaatgaaagaggccatcacagctaatcctatggtcaccaaaaggattagaaagaaacatggacaactctgtccataaatttgataacttagctaaaatggaccaattccttgcaagacgcattctctcaaagctcacacaagatagacctcaataggcatatgtatctattaaataaaccaaagcagtaattaataaccttccaagg

SEQ ID NO: 13061 - DNA, 474 bp, Homo sapiens
ttaaatagcttttttaatttgtaaattaaaatcttacaaactaaatcagtgtgctgctagagggttctttttcacttgacatgcttattagaaagctgacccaacaagagctctctgcctccggtcactcttgctgtggtgctacgtggaagtgaatggagactgatctcaaatctgaactgcagctttcgctgctgtgagttggggatatgatagtcagctcaggcttcagattgtatgagaaaaatgaagagaagtcaacaaatattttggtactcttcattcatttatctctaaaaccaggagttgaattttcctcatcttgaaagactcttggggtctgtttctggtattttacaaaattgctaagtggaatgcatgaattgcattatgttctctggtacacgtagagttcagacccttctgaactctgttgatataccacaccatgttctggaccatagctctgcatct

SEQ ID NO: 13062 - DNA, 553 bp, Homo sapiens
gagccaccaaaatggtggtgttcgggtatgaggctgggactaagccaagggattcaggtgtggtgccggtgggaactgaggaagcgcccaaggaaatgaaacacgatttccaaaatgaacttaatctttcatgagaaactgaggatagagatgtcaataagcagccactgtttccacctccccacctgaagagctaggaggacaactacaaacagcctgactgccttctcggaatgaggagagaggaaaacagcaacagtatcagttttcaagatggcagcatctatgcatggtcagcccagtccttctctagaagatgcaaaactcagaagaccaatggtcatagaaatcatagaaaaaaattttgactatcttagaaaagaaatgacacaaaatatatatcaaatggcgacatttggaacaacagctggtttctctggaatattctcaaacttcctgttcagacgctgcttcaaggttaaacatgatgctttgaagacatatgcatcattggctacacttccatttttgtctactgttgttactgacaagc

SEQ ID NO: 13063 - DNA, 534 bp, Homo sapiens
acagaagggcagaagcagaccactctgtgcaccaacctaaaaaattacagagaagagaaaattatctttggattgtgctgccctatataaaggtggcagaaagacatttttaaaaagcttattatttcttgcattattttaaaaagttcagagttgaaatgcctttcaaccatttccttctgtggtcatttttcttgctgcctttttcacccaagattcagcagtcagatgtttactgcacacctattacctattatttgctgttcttgcatggttcaaaccaccattctgtagccacccatcctttgccttatctaacaaacatttttccaggaaggtggaaaaggaagtgttgctctcattgtgtgactcagtgctgctgtccatcccatggaaacatgggcacaatcaagtatttgtccagcctattgcaggcttttcctgactttaaaataaattgtgatcaataatagtacctttgattatacatttattattgtgtctctctctgatgtactgtggattgtacattta

SEQ ID NO: 13064 - DNA, 519 bp, Homo sapiens
gacagaagggctttttctctgcacggagccggcgcttttgcagttgcttctgcggaaaggtggtagttaagaatttgtaaaggccagagaactacctacgattctctcagcggtctctcttctcctcaagtttgaaatgctttatctcatcgggttgggcctgggagatgccaaggacatcacagtcaagggcctggaagttgttagacgctgcagtcgagtgtatctggaagcctacacctcagtcctaactgtagggaaggaagccttggaagagttttatggaagaaaattggttgttgctgatagagaagaagtggaacaagaagcagataatattttaaaggatgctgatatcagtgatgttgcattccttgtggttggtgatccatttggggccacaacacacagtgatcttgttctaagagcaacaaagctgggaattccttatagagttattcacaatgcctccataatgaatgctgtaggctgctgtggtttacagttatataagtttgg

SEQ ID NO: 13065 - DNA, 577 bp, Homo sapiens
gcatgaactgaatgttccatttttcaaagttggatctggagacactaataattttccttatctggaaaagacagccaaaaaaggtcgcccaatggtgatctccagtgggatgcagtcaatggacaccatgaagcaagtttatcagatcgtgaagcccctcaaccccaacttctgcttcttgcagtgtaccagcgcatacccgctccagcctgaggacgtcaacctgcgggtcatctcggaatatcagaagctctttcctgacattcccatagggtattctgggcatgaaacaggcatagcgatatctgtggccgcagtggctctgggggccaaggtgttggaacgtcacataactttggacaagacctggaaggggagtgaccactcggcctcgctggagcctggagaactggccgagctggtgcggtcagtgcgtcttgtggagcgtgccctgggctccccaaccaagcagctgctgccctgtgagatggcctgcaatgagaagctgggcaagtctgtggtggccaaagtgaaaattccggaaggcaccattctaacaatggacatgctcaccgtg

SEQ ID NO: 13066 - DNA, 569 bp, Homo sapiens
ggaagttggtgtttcgctgggccctggtactgaagacgcggtccgggtcgcccctagctgtttcctactcacccaaagccccgcacccgccttttctctctctcctctggcaggatgaggcgtgcaggcctgggtgaaggagtacctcctggcaactatgggaactatggctatgctaatagtgggtatagtgcctgtgaagaagaaaatgagaggctcactgaaagtctgagaagcaaagtaactgctataaaatctctttccattgaaataggccatgaagttaaaacccagaataaattattagctgaaatggattcacaatttgattccacaactggatttctaggtaaaactatgggcaaactgaagattttatccagagggagccaaacaaagctgctgtgctatatgatgctgttttctttatttgtcttttttatcatttattggattattaaactgaggtgatgcatgtaattgtgaatttggaatttgttccaacttaatggcttgcagtaccactttgataaaaatcagcatcaaaacattcccagtgttcaaatact

SEQ ID NO: 13067 - DNA, 365 bp, Homo sapiens
tacggctgcgagaagacgacagaagggtacggctgcgagaagacgacagaagggtacggctgcgagaagacgacagaagggtacggctgcgagaagacgacagatgggtacggctgcgagaagacgacagaagggtacggctgcgagaagacgacagaagggtacggctgcgataagacgacagaagggtacggctgcgagaagacgacagaagggtacggctgcgagaagacgacagaagggtacggctgcgagaagacgacagaagggtacggctgcgagaagacgacagaagggtacggctgccagaagacgacagaagggtactgctgcgagaagacgacagaagggggtggctcacgcct

SEQ ID NO: 13068 - DNA, 164 bp, Homo sapiens
ttaaataacagtgcaatttcaaaaaaatttataactttcttttgatcatcatgtacagaggtgttttttttctttaggcttctcatgcatatgaatattttaagcacgaatggactactaaatatctgagtttttttttttttttttttaaagatcctaacaaa

SEQ ID NO: 13069 - DNA, 583 bp, Homo sapiens
gacagagggggcagacgaggtcatgaatcatgtgacggtggcttgaggaggaacctgtctttaaagctgtccctgaagtgacagcggagagaaccaggcagcccagaaaccccaggcgtggagattgatcctgcgagagaagggggttcatcatggcggatgacctaaagcgattcttgtataaaaagttaccaagtgctgaagggctccatgccattgttgtgtcagatagagatggagtacctgttattaaagtggcaaatgacaatgctccagagcatgctttgcgacctggtttcttatccacttttgcccttgcaacagaccaaggaagcaaacttggactttccaaaaataaaagtatcatctgttactataacacctaccaggtggttcaatttaatcgtttacctttggtggtgagtttcatagccagcagcagtgccaatacaggactaattgtcagcctagaaaaggaacttgctccattgtttgaagaactgagacaagttgtggaagtttcttaatctgacagtggtttcagtgtgtaccttatcttcattataacaacacaatatcaatc

SEQ ID NO: 13070 - DNA, 386 bp, Homo sapiens
acagaaggggtgatcaccttactctgctgctgcttctacttgtcacatctgagactgtttcttaaaatagagctccccagcagcaatttttcattatatggcctcatcgtgcatgtatttggtatgaactctgataagagattatgatgttgatatcataagaatttccctcttttacagaacatgaaaaaatgcatgcatttaggttaagcattgactatatattggaaatgtagttaaaaaaaactgtacaggtccagcacggtggctcacgcctatagtccctgcactttgggaggccagggcaggtgggtcacttgagatcaggagttagagaccagactggccaacatggtaaaaacaaatctctactaacaaaaaatacc

SEQ ID NO: 13071 - DNA, 101 bp, Homo sapiens
ggaaagagctgaggttcttacccttgttgcatgctgccacctctccttagccagtgctcttgtacatccacacagcaccctaaggagccatagtcaccatc

SEQ ID NO: 13072 - DNA, 615 bp, Homo sapiens
gggtccagggcttccatgctgctccccaagagtgaagccaaactacttgaagggtctttctcatgtacttaacaggctgcccaagcctgtactcttgccagagctgcccacgcttctttccttgctgctggaggccctgtcctgccctgactgtgtggtgcagctctccaccctcagctgccttcagcctcttctactggaagcaccccaagtcatgagtcttcacgtggacaccctcgtcaccaagtttctgaacctcagctctagcccttccatgtctgtccggatcgccgcactgcagtgcatgcatgctctcactcgcctgcccacccctgtgctgctgccgtacaaaccacaggtgattcgggccttagccaaacccctggatgacaagaagagactggtgcgcaaggaagcagtgtcagccagaggggagtggtttctgttggggagccctggcagctgagccctcagtcctggcctagactgttctgacaatctaacctgggattactaactgttgagccatcttccccaaagcagggaaaccactggtctctgactgcctttcccacagacacagcacaaatgctaggcctctgttgcatggctgta

SEQ ID NO: 13073 - DNA, 489 bp, Homo sapiens
gctcttccggagcctgcagcatggggcccctgccgcgcaccgtggagctcttctatgacgtgctgtccccctactcctggctgggcttcgagattctgtgccggtatcagaatatctggaacatcaacctgcagttgcggcccagcctcataacagggatcatgaaagacagtggaaacaagcctccaggtctgcttccccgcaaaggactatacatggcaaatgacttaaagctcctgagacaccatctccagattcccatccacttccccaaggatttcttgtctgtgatgcttgaaaaaggaagtttgtctgccatgcgtttcctcaccgccgtgaacttggagcatccagagatgctggagaaagcgtcccgggagctgtggatgcgcgtctggtcaaggaatgaagacatcaccgagccgcagagcatcctggcggctgcagagaaggctggtatgtctgcagaacaagcccagggacttctgg

SEQ ID NO: 13074 - DNA, 507 bp, Homo sapiens
gatcgtggtggatggggtatttcaccacgtggtgctggctacacatttggacaagacatttctgaaacctttaaccatgccaatggtctcacactggtttctcgtgcccaccagcttgtaatggagggatacaattggtgtcatgatcggaatgtggttaccattttcagtgcacccaattactgttatcgttgtgggaaccaggctgctatcatggaattagatgacactttaaaatattccttccttcaatttgacccagcgcctcgtcgtggtgagcctcatgttacacggcgcaccccagactacttcctataaatttctcctgggaaacctgcctttgtatgtggaagtatacctggctttttaaaatatatgtatttaaaaacaaaaagcaacagtaatctatgtgtttctgtaacaaattgggatctgtcttggcattaaaccacatcatggaccaaatgtgccatactaatgatgagcatttagcacaatttgagactg

SEQ ID NO: 13075 - DNA, 453 bp, Homo sapiens
acatctttaaacaactttgattttacttttgtatttggtgatagatactagtctgttttcattcttctgcatatggatatccagttttttcaataccatttcccaccagtgtatgttcttggcacctttgtcaaaaatgagttttctgtggggacatttgtacatttgttacttttctctattctgttccattgatctatgagtctatttttatgccagtaccatactcttttggttgctataattctgtggtataatatgaagtcagaaaatataattcctccagttttatttatttatttatttttgcttaggatagtattatttcttatagtgaaagcattctatgttatttattattagtctaattttgtagttttacaatgctatcctcttttacaaagctatgatcaactcagtgtgtccagatcaggatcatttgtagctatttgc

SEQ ID NO: 13076 - DNA, 285 bp, Homo sapiens
aacaatattggtcttccaggtgttactcatttcaattatgtgtagtataccaggacagacctattttcatgtcttatttctttaaagagctgcttcattggccgggcgccatggctcacgtctgtaatcccagcactttgggaggccgaggcgggtgggttacttgaggtcaggagttcgagaccagcctggcaaacatggcgaaaccccatcttaactaaaaatacaaaaaaattagccgggtgtggtgtcacgcgcctgtaatcccagctacttggggggctc

SEQ ID NO: 13077 - DNA, 372 bp, Homo sapiens
caaccggtacacatttaatgaggtgagggggagcttccggagtggtttgtgcaagaagaaaagcagcaccggatacgacagttgcctgttggtaagaaggaggtggagcattaccggaaacgctggcgggaaatcaatgcacgtcccatcaagaaggtggctgaggctaaggctagaaagaaaaggaggatgctgaagaggctggagcagaccaggaagaaggcagaagccgtggtgaacacagtggacatctcagaacgagagaaagtggcacagctgcgaagtctctacaagaaggctgggcttggcaaggagaaacgccatgtcacctacgttgtagccaaaaaaggtgtgggccgcaaagtgcgccgg

SEQ ID NO: 13078 - DNA, 87 bp, Homo sapiens
gactacattttgctctgtgaactatcccctgcgctttgaacgtgccagcagcccttgtttatatgcccattcttttcacttcctctc

SEQ ID NO: 13079 - DNA, 60 bp, Homo sapiens
gtagcagcccacggagatcctaagctggctgtcttgtgtgcagcctgagtggggtggtgc

SEQ ID NO: 13080 - DNA, 613 bp, Homo sapiens
acagaaggggggctttgcgaagatggcggcgctgggggtgctggagtccgacctgccaagtgccgtgacacttctgaaaaatctccaggagcaagtgatggctgtaactgcacaagtgaaatcactgacacaaaaagttcaagctggtgcctatcctacagaaaagggtctcagcttcttggaagtgaaagaccagctgctgctcatgtaccttatggatttgacccacctcattctggacaaagcctcaggaggatctcttcagggacatgatgcagttttgagactggtggagattcgcacggttttggaaaagcttcgtcccttggaccaaaagctgaagtatcaaattgacaagctgatcaagactgcagtgacaggcagccttagtgagaatgacccacttcgttttaagcctcatcccagcaatatgatgagcaagttgagctctgaggatgaggaggaagatgaagcagaagatgaccagtctgaggcttcagggaagaaatctgtgaagggagtgtctaagaaatatgttcctccacgcttggttccagtacattatgatgaaacagaagctgagcgggagaagaagcgtctagaacgagccaag

SEQ ID NO: 13081 - DNA, 531 bp, Homo sapiens
gctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttaagggcaaacgtgtgagatgtgtcagacctgccttggtgtctgtgctgagcataaagaatgtgttcagt

SEQ ID NO: 13082 - DNA, 122 bp, Homo sapiens
gctgcgagaaggacgacagaaggggttaatagaaagttggccaatttcaccccattttctgtggtttgggctccacattgcaatgttcaatgccacgtgctgctgacaccgaccggagtact

SEQ ID NO: 13083 - DNA, 450 bp, Homo sapiens
tgcaggaactgcttgcctaataacaaggaacagcggctggatttattggttttggaacatctcagagtgacctaggctatgttcctgctattcaaggagctgaatatattgacagtcttgtaaattctgatttccgaatggagctgcggaaactttcatagaaagatgtcaccacaaaattaacagctatgcaggaatttggaaccatgtgtacagagagagacacaggactgagaaaggagttcttacatattggccaagaatattgtgcttaatttcacttgatcatgaccgtcgcgttcgagaagccactcaacaagcttttgagaaacttatccttaaagtaaagaagcagttggctccctacttacaaagtttagtgggatattggctaatggctcagtgtgatacttacacaccagctgcgtttgcagcaaaagatgcatttga

SEQ ID NO: 13084 - DNA, 588 bp, Homo sapiens
aactacagtgtaaacatatcccagatgaaaactgctgtatggaaaaatgacagaaagtaactgattgacactgttgattcacagttcaacctcctatctgggaaagacatttctttcctctgctcactttaagaacttttaccgactccaaaaatctcaggaattaaacttttaacagttacagcaataaagaatagttagtactccaaaaatattatatttaagatgctcaacaagaaaaaaatgcaaatgtaatatttttttcaaattacttctttattgacttgtccaaatttcaaaagtgcctacccttcaataaaacttttttattctgatctccataaattacttagtcttctatgtatagctatcaaggaaataaaaccaattttgccacagccacaactgtaaatgtttttgtacccatgctgaaactcataacaacacagacataaaaatagctgtgaggttttgctttttttgttgtcagctatcttaagaatcattaaatacacctgctttgggtaaaactctttgcaagcagtaattaacactagtaacagtgaaagcacaagatttccaaatcag

SEQ ID NO: 13085 - DNA, 313 bp, Homo sapiens
gaagggcaagcagagccaaaagcaagtactatgcaagtgaaaactactttctaatcaagattttacaaatatatttcttttttttttgaaacggagtctcgctttgtcccccaggctaaattgcagtggtgccatctcggctcactgcaacctccaccccccaggttcaagcaattctgtctcaccctcctgagtagctgggattacagtgcccgccactacgcctggctaatttttttgtatttttagtaaagacgggtttcaccatttgagccaaactggtcttgaactcctgaccttgtgatctgcccgc

SEQ ID NO: 13086 - DNA, 83 bp, Homo sapiens
ggcatggcatcctgctcgtgtagccttctctgtggcacgcgctgggcagaaaggctaccatcaccgcactgagatcaacaaga

SEQ ID NO: 13087 - DNA, 507 bp, Homo sapiens
acagaagggggtgtcagctccgcagggtttggggaaacggccgctgagtgaggcgtcggctgtgtttctcaccgcggtcttttcctcccactcttggctggttggaccccgctatggaaaagttggcccctgagccagagctccagcagccttgttagggcgtggcctgaggcttggataagtgggatgtaaaacgaagatcaggagcagatttgaagaattacaaagtgaattggtgccagtcagcatgtcagagacagaccacatagcctctacttcctctgataaaaatgttgggaaaacacctgaattaaaggaagactcatgcaacttgttttctggcaatgaaagcagcaaattagaaaatgagtccaaactattgtcattaaacactgataaaactttatgtcaacctaatgagcataataatcgaattgaagcccaggaaaattatattccagatcatggtggaggtgaggattcttgtgccaaaacagacacaggctc

SEQ ID NO: 13088 - DNA, 372 bp, Homo sapiens
ttttgcccttggggttaaagggattttcctgcctaaccctcccaagaagttggaataacaggcccctgccaccaccccgggttaatttttattttttaagtgaaaacagggtttcaccttgtgggccaggttgatttaaaactcctgacctaagggaattcccccccctaaccctcccaaagggcggggattacaggcttaaccccccgggccggacctattaaaaaatttttttaaagtccagtcctaataaactagggactacctaaaaaccacccttttaaatattatttttttaaacaaaaataaaaaatactgtttatataaaaattaaccttaaatacccgtataggaaaaaatttttttgcccat

SEQ ID NO: 13089 - DNA, 654 bp, Homo sapiens
tcggcacgaggccgtgaccctgcgcgggccttcgccctggggcttccgcctggtgggcggccgggacttcagcgcgcccctcaccatctcacgggtccatgctggcagcaaggctgcattggctgccctgtgcccaggagacctgatccaggccatcaatggtgagagcacagagctcatgacacacctggaggcacagaaccgcatcaagggctgccacgatcacctcacactgtctgtgagcaggcctgagggcaggagctggcccagtgcccctgatgacagcaaggctcaggcacacaggatccacatcgatcctgagatccaggacggcagcccaacaaccagcaggcggccctcaggcaccgggactgggccagaagatggcagaccaagcctgggatctccatatggacaaccccctcgctttccagtccctcacaatggcagcagcgaggccaccctgccagcccagatgagcaccctgcatgtgtctccaccccccagcgctgacccagccagaggcctcccgcggagccgggactgcagagtcgacctgggctccgaggtgtacaggatgctgcgggagccagccgagcccgtggccgcggagcccaagcagtcaggctccttccgctacttgcagggcatgct

SEQ ID NO: 13090 - DNA, 644 bp, Homo sapiens
cggcggtcatggaacgccaagaggagtctctgtccgcgcggccggccctggagaccgaggggctgcgcttcctgcacaccacggtgggctccctgctggccacctatggctggtacatcgtcttcagctgcatccttctctacgtggtctttcagaagctttccgcccggctaagagccttgaggcagaggcagctggaccgagctgcggctgctgtggaacctgatgttgttgttaaacgacaagaagctttagcagctgctcgactgaaaatgcaagaagaactaaatgcgcaagttgaaaagcataaggaaaaactgaaacaacttgaagaagaaaaaaggagacagaagattgaaatgtgggacagcatgcaagaaggaaaaagttacaaaggaaatgcaaagaagccccaggaggaagacagtcctgggccttccacttcatctgtcctgaaacggaaatcggacagaaagcctttgcggggaggaggttataacccgttgtctggtgaaggaggcggagcttgctcctggagacctggacgcagaggcccgtcatctggcggatgaggctaagaatcttgttagtgtcacttttgacattagcaagatgaacccttaaccctcgattcaattgcctta

SEQ ID NO: 13091 - DNA, 381 bp, Homo sapiens
gcggccgcgcccgtgcacgagcagtccctggggtctgtagtggcctctggagagcccttctccccaggccaggcgggaaggcccccgctccggcctggttgaagtaggggaacgggtcccaacgcggggccgactcccttgaccctctgacttgctggcttcccttgttttacagtcctcggcctggcggaagttttgcaggttgtgaagacccctagtctttcattctctccttgtcacagccttgtagggcgtgaaggggtcattgccccatttagggatgcgcacctcctgatttcccgtccactgctctgcgccctgaagtggctgaaaagtgctcttaaaaggatgggaatcccgtcgccctcagctggtgcgctc

SEQ ID NO: 13092 - DNA, 618 bp, Homo sapiens
  misc_feature 611: n = A,T,C or G
tttgatcatttgctccagatgctgtgtaaccttggcaaggaacgctttctggagctggcacctgactttgtgggtgacattctctgggaacatctggagcaaatgatcaaagaaaaccaagaaaagacagaagatcaatatgaagaaaattcacacctcacctccgttcctcattggattaacagcaatacattaggttttggcacagagcaggcgccctatggaatgcagacacagaattaccccaaaggcggcctcctggacagcatgtgtccggcctccacacccagcgtactcagctctgagcaggagtttcagatgttccccaagtctcggctcagctccgtcagcgtcacctactgctctgtcagtcaggacttcccaggcagcaacttgaatttgctcaccaacaattctgggactcccaaagaccacgactcccctgagaacggtgcggacagcttcgagagctcagactccctcctccagtcctggaacagccagtcgtccttggctgatgtgcaacgggttccttccttcgagagcttcgaagatgactgcagccagtctctctgcctcaataagccaaccatgtctttcaaggatacatncaagaga

SEQ ID NO: 13093 - DNA, 515 bp, Homo sapiens
gacagaggggtcccagatccctcaggacttgccctatgagacactgatcagcagagcaggagacctttttgttcagtttcccccatccgaacttgctcgggaggccgctgcccaacagcaagctgagaggacggcagcctctactttcaaagactttgagctggcatcagcccagcagaggcctgatatggtgctgcggcagcggtttcggggacttctgcggcctgaagatcgaacaaaagatgtcctgaccaagccaaggaccaaccgctttgtgaaattggcagtgatggggctgacagtggcacttggagcggctgcactggctgtggtgaaaagtgccctggaatgggcccctaagtttcagctgcagctgtttccctgaaagccagagaagaccttcctcttacatcacattaaggcacccactcactaccttggcgtcgttttttgggtctgacttgtctcgtcaactgctggtctctcccacctggttggaaatgtcgttggaaact

SEQ ID NO: 13094 - DNA, 334 bp, Homo sapiens
ctctcttagcacaggaaggtggaaacaaaatgccaggcctctgctctgaagagcaaaactgctgtcgctgcagtatctgataccagacatccacatatccacaagaagtgcctcttaggtctgtgacagagagtgtgtctccattcctcagttcccagaaaggggagaggtttggcctaaaaagcatgtagatgggggagaaatgggtggggggagaggaacagccattaacacagtatcatgtttaacaagtatagccttgatttcagtagatgtaatggaagccaaattaaattgatacagaacccatttctcagagtcttttttttttttg

SEQ ID NO: 13095 - DNA, 444 bp, Homo sapiens
tcctttcgccgtttccgaaccgagggattgctactcgcctttggcttggcggtctctgtgctcgggggtccgaaaactgctggaaggcccccggtctctggaggggagcaggcggtagcgagtttagtgacgtggagcaggcgcagaacagtcggagatttgaagagatttcctgggtgtggagtgtgactttccaaaaccagcttttccttgagctgtatttgttgcagcaatgtttaggagattgacttttgcacaactgctttttgccactgtccttggaattgctggaggagtatatatttttcaaccagtatttgaacagtatgccaaagatcagaaggaattaaaagaaaagatgcagttggtacaagaatcagaagagaagaaaagttaatactacatggagttaggcctggcgcagtggctcacgcctgtaatccc

SEQ ID NO: 13096 - DNA, 547 bp, Homo sapiens
ggcgcatgctccgggtgtcccggagttgtcctgcgccggtgttcccacgtgcggcctgaacctgagcgcataatgttatgaggagatgggagcactagtgattcgcggtatcaggaatttcaacctagagaaccgagcggaacgggaaatcagcaagatgaagccctctgtcgctcccagacacccctctaccaacagcctcctgcgagagcagattagtctctatccagaagttaaaggagagattgcccgtaaagatgaaaagctgctgtcgtttctaaaagatgtgtatgttgattccaaagatcctgtgtcttccttgcaggtaaaagctgctgaaacatgtcaagagccgaaggaattcagattgccgaaagaccatcattttgatatgataaatattaagagcattcccaaaggcaaaatttccattgtagaagcattgacacttctcaataatcataagcttttcccagaaacctggactgctgagaaaataatgcaagaataccagctagaacagaaagatgtgaattctcttcttaat

SEQ ID NO: 13097 - DNA, 420 bp, Homo sapiens
attatcaatatggtgcttgaatatattcctataactgtagaacagtgtggaaagtgatggtaactttgaagttgttcatgttttattggctttgttttaattgacactagtagagttttaatggtctttgtgtaaattttaatggcttttccattgtttttgcttctcttaaaaagtttaagaagaatatgacctcattaaatgtgctgttttatttggaccagtcacacaaaatgtctctctagagttgactttaaagttgtttacagaaatttaaactcaattccagagattgaagttgtccaaacagctcatgggcttagtgtccaaacccctgcccagccttccctttccaagttggtgccacctccaggtagccattggtggttttcctattactgatgtggctgtggaatgata

SEQ ID NO: 13098 - DNA, 95 bp, Homo sapiens
agttgtggcagctggtaagctgtttgactaggcatgaattatttttagaacaaatgtgtttcagtcagtaactctatatgcctttctatgaaatg

SEQ ID NO: 13099 - DNA, 565 bp, Homo sapiens
gtctgggacttatgggataacatttatactccttcacatggcatgtggagtttttcttcatctcgttgtaatctgattctccagtctcatcccttcttctccccgactttacgttgcatcaatagaagctacttgtagtttcctgatgttatactactatgtgcaacatctctgacatagaccttgtttgtatctgttggtgtggacttccaactttatctagtaaaagtagtcattaaaactaagtgtagttgcatttacttcctgcaaagtttttttttcagactctttgatagaattaaccctttctctcttttttaatacttctgggttctcatatgtgatgttctaatacttcctccaattgatttctactctttctctggacacttttttttgtttttgtgaaatatatcttagtcatatttatctcacatttgtgaaacttcaaaaaaaagctttcattagacagttgaaactatggattattttcatcatttattctagcaactgatgcatttcaaaatgttttgaataggactttataaaactaaaatttattact

SEQ ID NO: 13100 - DNA, 551 bp, Homo sapiens; identical to SEQ ID NO: 2223

SEQ ID NO: 13101 - DNA, 280 bp, Homo sapiens
aacttcatatataatcaataaaacaaaagaagtgaaaagaggagattgcagccaagaggaattcgttacaaacatgtatgagattttttaagttttttttgtttttaattattcctatttcacgttcacatggaaaagtcagaaagcataactactctaggccgggcgccgtggcacacgcctgtaatcccagcactctgggaggccaaggcaagtggatggcttgagtccaggagttttgataccagcctggggaatatagtgaaaccccgtctgtcct

SEQ ID NO: 13102 - DNA, 599 bp, Homo sapiens
gggcagattgcattcacaggaactacttttattggctatgtaggattatggactggccagagcccacacaagtttacagtttctggtgatgaacgagataaaggctggtggtgggagaatgctatcgctgccctgtttcggagacacattcccgtcagctggctgatccgcgctaccctgagtgagtcggaaaacttcgaagcagctgttggcaagttggccaagactccccttattgctgatgtttattacattgttggtggcacgtccccccgggagggggtggtcatcacgaggaacagagatggcccagcagacatttggcctctagatcctttgaatggagcgtggttccgagttgagacaaattacgaccactggaagccagcacccaaggaagatgaccggagaacatctgccatcaaggcccttaatgctacaggacaagcaaacctcagcctggaggcacttttccagtgaaagcaggccaggtgcggtggctcacgcctgtaatcccagccctttgggaggccaaggcgggtggaacacttgaggtcgggagttcaagaccagcctggccgacatggtgaaacctcgtc

SEQ ID NO: 13103 - DNA, 570 bp, Homo sapiens
ggcaaacgcggtgggggctgctcggcggtcaggagcagcaagagacagagcgacatgagagattggaccgcgggctgcactggagaatttactggtaggataattcatccctaaagagattgaagtgagcttcagaatggcaaaagaggagccccagagtatctcaagggacttgcaggaactgcagaagaagctgtctctgctgatagactccttccagaataactcaaaggtggtggcctttatgaagtctccagtgggtcagtacttggacagccatccgtttctggccttcaccttgctggtgttcattgtcatgtcggccgttcctgttggattcttcctgctcatcgtggtgcttaccaccctggctgctctgctgggggtcataatattggaaggattggtcatctctgtgggtggcttctcactgctctgcatcctctgtggtttgagcttcgtatcactcgccatgtcggggatgatgatagcatcttatgtagtggtctccagcctcatcagctgctggttttctcccaggccactgacacagcaaaacaccagttgtga

SEQ ID NO: 13104 - DNA, 579 bp, Homo sapiens
  misc_feature 79: n = A,T,C or G
gacagaaggggattttggtgcagagcggctaaagattccagaaggattatttgacccttccaatgtaaaggggttatcnaggaaacacaatgttaggagtcagtcatgttgtcaccacaagtgttgggatgtgtgatattgatatcagaccaggtctctatggcagtgtaatagtggcaggaggaaacacactaatacagagttttactgacaggttgaatagagagctgtctcagaaaactcctccaagtatgcggttgaaattgattgcaaataatacaacagtggaacggaggtttagctcatggattggcggctccattctagcctctttgggtacctttcaacagatgtggatttccaagcaagaatatgaagaaggagggaagcagtgtgtagaaagaaaatgcccttgagaaagagttcccaagcttctaccttccttttgtcaccttacgtttcatagctttagtatactcaggaaaagaatgaccatcttttgtagaatgtttatacatttttgcatatttcaatttccacttaaattttttaaagctttaactggctctataaattaag

SEQ ID NO: 13105 - DNA, 456 bp, Homo sapiens
atccaagagggcaaaagccatcagaaccagcatgaggctcactttgtggtagagctgtgcaagtacttcctgtgccaggaatacctgccttcccagatcaccatcctcactacctataccgggcagctcttctgcctgcgcaaactgatgcctgccaagacatttgctggcgtcagggtccatgttgtggacaaataccaaggggaagagaatgacatcatcctcctctcgctagtgcggagcaaccaagaaggcaaggctgggcgcagtggcttacgcctgtaatcccagcactttgggaggccgaggcaggcggatcacgaggtcaggagttcgagaccagcctgaccaacatggcgaaaccccgtctctactaaaaatacaaaaattagctgggcgttatggcgggcgcctgtaatcccagctacttgggaggctgaggcagaagaatcgctt

SEQ ID NO: 13106 - DNA, 557 bp, Homo sapiens
acagaaggggaattacgagcaacccaccaaagaggcattgaccacagtaacattggcaacaagatgctgcaggccatgggctggcgggaaggctctggcttgggacgaaagtgtcaaggcattacggctcccattgaggctcaagttcggctaaagggagctggcctaggagccaaaggcagcgcatatggtttgtcgggcgccgattcctacaaagatgctgtccggaaagccatgtttgcccggttcactgagatggagtgagagagagagagagagagagatgacaaggagcacaagaagtggtccatctcccgaattcgctgttaccgcctgtctctttaagggcatgccttgtgctgttaatagatcttagggtgaaccacttcattctgcagggttctccctcccaccttaaagaagttccccttatgtgggttgcctggtgaatggccttccttcccgccagagggcttgtgaacagaccggagaggacagtggattgtttatactccagtgtacatagtgtaatgtagcgtgttacatgtgtagcctat

SEQ ID NO: 13107 - DNA, 606 bp, Homo sapiens
gtcccaaatcattgcaaagacatgaaaaaactcacactggagagaaactctatgaatgcaagcaatgtggtgaagccttcagtagtcccagttcctttcgataccatgaaaggactcacactggagagaaaccctataaatgcaagcaatgtgggaaagccttcagagctgcctcagtccttcgaatgcatggtaggactcaccctgaagataaaccctatgagtgtaagcaatgagggaaagccttcagatctgcctcacacctttgaatgcatggtaggacacacaatcaagagaaaccatgaatgtaaagaatgtgggaaacccttcaggtctgcccagaaccttcgaattcagtaaaggacacaagcacacataagaatgcattctggatagctgaacaaaaggcagcagaaacttctgcagacttaaatgtccctgtctgacagctttgaagagagtagcagtcctcccagcatggagtttgagatctaagaatggacagtctgcctcctcaagtgggtccctgatctccaagtagcctaactgggaagcacttcccagtaggggccaactgacacctcatacggccgtgtgcccctctgt

SEQ ID NO: 13108 - DNA, 86 bp, Homo sapiens
gagcacaaggccgagatcatcactgtcagcgatggccgaggcgtcaagttcttctagcagggacctgtctccctttacttcttacc

SEQ ID NO: 13109 - DNA, 501 bp, Homo sapiens
acgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggggtctcatgggtctatacgtatgtcaaagcttatctaattgtatactttaaatatgtgcagttcattgccagccaattatactcaatctgtttttaaaagtaaaatgtgcttcttataagtaacaattttttaaaatgtagtctgatgacctttgtcttttaattagagaatttaatctgtttacatttaataactgatataggcagggcacggtggctcccgcctgtaatcccagcactttgggaggccgaggcgggtggatcacctgacgtcgggagttgaagaccggcctggccaac

SEQ ID NO: 13110 - DNA, 627 bp, Homo sapiens
acagaagggccgactgcggggcagtgaagcactgcctgcagaccgtttggaacaagccaacagtgaaatcccttccctgcgacatatgcaaagacgttgtcaccgcagctggtgatatgctgaaggacaatgccactgaggaggagatccttgtttacttggagaagacctgtgactggcttccgaaaccgaacatgtctgcttcatgcaaggagatagtggactcctacctccctgtcatcctggacatcattaaaggagaaatgagccgtcctggggaggtgtgctctgctctcaacctctgcgagtctctccagaagcacctagcagagctgaatcaccagaagcagctggagtccaataagatcccagagctggacatgactgaggtggtggcccccttcatggccaacatccctctcctcctctaccctcaggacggcccccgcagcaagccccagccaaaggataatggggacgtttgccaggactgcattcagatggtgactgacatccagactgctgtacggaccaactccacctttgtccaggccttggtggaacatgtcaaggaggagtgtgaccgcctgggccctggcatggccgacatatgcaagaactatatca

SEQ ID NO: 13111 - DNA, 452 bp, Homo sapiens; identical to SEQ ID NO: 2244

SEQ ID NO: 13112 - DNA, 51 bp, Homo sapiens
atatgatgaagggtctaatctcaaaaaacagaccaataagaaccgggtgca

SEQ ID NO: 13113 - DNA, 580 bp, Homo sapiens
gcggccgcaggtctgcgaggcgctgctcttcgccctgttgctccagaccggcgtgtgctatggcatcaagtggctggcgctgtccaagacaccatcggccctggcactgaaccagacgcaacactgcaagcagctggagggtctggtgtctgcacaggtgcagctgtgccgcagcaacctggagctcatgcacacggtggtgcacgccgcccgcgaggtcatgaaggcctgtcgccgggcctttgccgacatgcgctggaactgctcctccattgagctcgcccccaactatttgcttgacctggagagagggacccgggagtcggccttcgtgtatgcgctgtcggccgccgccatcagccacgccatcgcccgggcctgcacctccggcgacctgcccggctgctcctgcggccccgtcccaggtgagccacccgggcccgggaaccgctggggaggatgtgcggacaacctcagctacgggctcctcatgggggccaagttttccgatgctcctatgaaggtgaaaaaaacaggatcccaagccaataaactgatgcgtctacacaacagtgaagtg

SEQ ID NO: 13114 - DNA, 500 bp, Homo sapiens
cgggatgattggaatagcttctggaatttgttcaagttttgggtatgtttaatctgttatgtactagtgttctgtttgttattgttttgttaattacaccataatgctaatttaaagagactccaaatctcaatgaagccagctcacagtgctgtgtgccccggtcacctagcaagctgccgaaccaaaagaatttgcaccccgctgcgggcccacgtggttggggccctgcctggcagggtcatcctgtgctcggaggccatctcgggcacaggcccaccccgccccacccctccagaacacggctcacgcttacctcaaccatcctggctgcggcgtctgtctgaaccacgcgggggccttgagggacgctttgtctgtcgtgatggggcaagggcacaagtcctggatgttgtgtgtatcgagaggccaaaggctggtggcaagtgcacggggcacagcggagtctgtcctgtgacgcgcaagtctgagggtctggg

SEQ ID NO: 13115 - DNA, 434 bp, Homo sapiens
atccatcattgcttttgcggtatcagtgcaagtgtccacaaagttaaaaaggcaaatcatgtcttagcattgttatgaaaatagcttcaacctctcaacccaacccccctttccccaaaggctctaggagacctgggggcccacgagccacaccctgaggtctgctctcctagcctgctgtcattgctaaagcctgcacgggcttcgacctgaagggggagctcaaggccttcccaatcttcttccttccctctcctccctgcccaccctttccctcaactttgggacaaaagagaccaggacggaagacacgaagggactctagctttggagttcaaacttccctcattccggctgggcgtggtggcccacgcctgtaatcccagcactttggaaggccaaggcaggcagattacttgaggtcaggagttcgg

SEQ ID NO: 13116 - DNA, 464 bp, Homo sapiens
gttggcagcaaaggtactattgagataaacccacgagacaccatggcaaaggagtcgagtataattggagttactctcttttcctcaaccaaggaggaatttcagcaatatgcatcagcccttcaagctggaatggaaattggctggatgaaacctgtgataggttctcaatatacattggagaaggtggccgaggctcatgaaaatatcattcatggtagtggggctactggaaaaatgattcttctcttatgatgattaattctttcatggatttcctatgtaattagaggtactgtctttcccccagttgtacttaccctatcttttctttaattaacatatcgattccatgagcttcttatgtgaaaaaataagatttttctttagagagcataagcagaagagtaaaatttattgtatagctagcaatatttttttatgccatctgtctcaaatcaaag

SEQ ID NO: 13117 - DNA, 475 bp, Homo sapiens
gggtggcgcgcgcggggacttaaagtaggtatgaagaccagggagacgtcgggccacaagggaacccactgaggtggggaccaaagatggtggctctttgaattggagccaagcgtggtgggcacccgctgagttggcctgtcataaagacggagttgacactttatccatggggcatcctactttccctacctgtcaacagtttccctctagagtggtatattttcaggtgaattccatttatgctattttctttccatctcatttgttccttcatcagtaggctcggtgatgagccttcccgagggcagggtcgatttcatgtttggttcacagatgtataccaaatacttcaaacaggtataccataaccattgaatgaatatgatggaccctaggggaaagacacggttctcctaatccagtccttgaggtgggtgagtgtgaaggcagaaatggaaagtaatggttacaa

SEQ ID NO: 13118 - DNA, 566 bp, Homo sapiens; identical to SEQ ID NO: 2252

SEQ ID NO: 13119 - DNA, 519 bp, Homo sapiens
acagaagggcaaagcccttcagtactttcaccccaagtccctcacccgtgacacctcccatatcccccccctcaaccggaaggctgactgcccggagaatgccaccatgtctctgaagcatctcaccaagaagctgctaaaccgggatatccaggttgggaagagcggacattcctctgtggaagatgcccaggccaccatggagctatataagttggttgaagtcgagtgggaagagcacctagcccggaatccccctacagactagtggcagtggggacgctggtgatatgaggaggcagaggcagcacccaggagaaacagggcagtggaccaatggacagctccaccagctccacatctttggaagctagatttggggagagagaagctctaccccagacttaatacccattgaaatttcacctcaggtgttgtgtcctgtgtctggttaagtgtcccatggaaggggaaagccttcacgtcagaacccaaccctataccttttacttcttaaat

SEQ ID NO: 13120 - DNA, 512 bp, Homo sapiens
gaaaaatgcggcctttgactgaagaggagacccgtgtcatgtttgagaagatagcgaaatacattggggagaatcttcaactgctggtggaccggcccgatggcacctactgtttccgtctgcacaacgaccgggtgtactatgtgagtgagaagattatgaagctggccgccaatatttccggggacaagctggtgtcgctggggacctgctttggaaaattcactaaaacccacaagtttcggttgcacgtcacagctctggattaccttgcaccttatgccaagtataaagtttggataaagcctggtgcagagcagtccttcctgtatgggaaccatgtgttgaaatctggtctgggtcgaatcactgaaaatacttctcagtaccagggcgtggtggtgtactccatggcagacatccctttgggttttggggtggcagccaaatctacacaagactgcagaaaagtagaccccatggcgattgtggtatttcatcaagcagacatt

SEQ ID NO: 13121 - DNA, 584 bp, Homo sapiens
gaaaactgggataaggaaatagagaaaatgcttcaagaggaaaattagctgttcctgaaatagaagaataatccttaacagtctgcaaactgacattaaattctagatgttgacaattactgaatcagaaggcatgaaagagtataattttatgaaattcaaaattattcttttttcaagttgaaacttgcctcttctactttaaaaaagtatatagaacagttacttctaataatcagaaagagatgttttatagaacatttctttaatataaagttagagatgtcttcataggcagtatggctatccttgccacagaaacataagtaaaattttagagttctgttttccatgaggtcaaaaatataatttattcctcagtcatggttttctaaatatctgtactccacattccattttaattgatatgagggtgttaaagtacctacttaatgggttgattactatcaaaatgaccaaattataccaaagaacttaagaggaagcactttcagaactattcacttgccaggtattttctaaaattccacctgaaagccaaaagataaaataaataagttgat

SEQ ID NO: 13122 - DNA, 556 bp, Homo sapiens
ggagcagggtgaggggaatgttatgggtaacagacatgcaggcatggctctacccatttctttgcacaagtatggggcccatgtggtagtccccatacccctccagttcctatatttttgtcttcttcctttcccctctttgccattcctaccttgcatttttcctgtcagtgccttagccaaggcaaggagataaggatctcttcttgctttttatatctgcacattcatacctctccaaagaccagcttttccccagccagggccctcagccttccctgctgccccagtgattgattgagagagctgttggggtttctctgccaatgacccctgggagagggactttggtagggttatgataaagtggcgggggtctggtcctgctcagggttttcatccttcctcctctccctcctctgtgactgtggatatggttataaggtggttgcacctgggagccctgacaactggctgcacaaattccaaaagtaaaggtgtcagtccctgtggccttccttggggcttctctgaccacatgtgcccaacttcaata

SEQ ID NO: 13123 - DNA, 509 bp, Homo sapiens
gatgtttaatgaatgcattttattttataaggctgagtacatatacagatgatcccattttagtttctcagctattttactatatgttaaatattttgatgctgtatttacatattagcatcagcaaccataatttttctgataacttttcaagatcagccaaatcatatccttgacaagtcacactttttctctgaagttttccataaaacccaaattaaaagtgatctgacactggtagcattttacaaatctaccttcatttagcatttatatatgcttttaagttgaagttttttctatatatgaaactgcaagtggttagagggcaggttttgtgttttaggtttgttaatttctctcccaaccagtgtcagattggctcagtctgagtggaggatcaatgaataggtgatgaatgaatggatatctacatgtcagtgcattgacagtgaatacatcttgcttatcatagtgaaagaaacagccggacacagtggctcatgcct

SEQ ID NO: 13124 - DNA, 426 bp, Homo sapiens
accaatgatggcgcgatgtaacacgagaaagcacataccaaggccaccacacaccacctgtccaaaaaggccttcgatacgggataatcctatttattacctcagaagtttttttcttcgcaggatttttctgagccttttaccactccagcctagcccctaccccccaattaggagggcactggcccccaacaggcatcaccccgctaaatcccctagaagtcccactcctaaacacatccgtattactcgcatcaggagtatcaatcacctgagctcaccatagtctaatagaaaacaaccgaaaccaaataattcaagcactgcttattacaattttactgggtctctattttaccctcctacaagcctcagagtacttcgagtctcccttcaccatttccgacggcatctacggctcaacat

SEQ ID NO: 13125 - DNA, 52 bp, Homo sapiens
ggcagggtgggggtgttagccctgggggttcccctccctcttgtgcaccatt

SEQ ID NO: 13126 - DNA, 207 bp, Homo sapiens
agtatggcctgcccatccaggttcgtgacgcaggattgtcttttaaagatgacatgccaaagtcagatgtcaacaaagagtactatacacagaatatggagagagagatttctaactctgatggaacacggccagttggcatgctggggaaagccacatctaccagtgacatgctgctcaaactggcccggaccacaccctactaca

SEQ ID NO: 13127 - DNA, 487 bp, Homo sapiens
gctctctgggatgtgtagctttggaaatctgtctttgttgctctgggagaggggactcctggaatgtgtctgtgaataaagactagccgaagatactgtggcctcatgaataggaatgtctgcccatatgtcaagattggaaataatggatgaagatcaattaatcaaagacgtcttggataaattccttaattgtcatgagcaaacatatgatgaagaatttctgaacacttttactcatctttcacaagaggatcatgtgtccaaaaggggagtgtttggaactgattcttcagaaaacatttttacctcagcaaaagttactcataaaaatgaagcagatgactaccatcttagaaataaaaccatctttcttcgtacttcatcacaatgtttggaagaacaggtagataatttcctagatttagaagatttggacatggatgaagagattaaaccccaaatgagtgaggatttgctgctgctt

SEQ ID NO: 13128 - DNA, 488 bp, Homo sapiens
agaatttaaaagtgaaacccagatttcctgtttggtcaatgagtagataaatatgcctgggataagaagcaggggaaggaagtgggagaaggatctgatgagtttgaggtacctgggagaccctaggaatgttgatatatagatatgaaactccataaaagtgtgatcagctgatcacctataaaaagttgatctgggctgactaatcaatatttggaagtcagaggcagtaaaatgacaaataaaggccttgggtgatgatgagctctctcagggaaaatgtttaaactgcaacaagagaagaaccttagggaagtatcaacatttaaggaatcagttggaaaatgggagcctacacagtagactatgaaggaccaaccaaaaagaacaagaactgggtggtatcatggaaacccagggaagagagggcttcaaaaaggaggatgtggtcagctgtagtgaatattactgagagattgtgatggctg

SEQ ID NO: 13129 - DNA, 508 bp, Homo sapiens
ataggtttggtcctagcctttctattagctcttagtaagattacacatgcaagcatccccgttccagtgagttcaccctctaaatcaccacgatcaaaagggacaagcatcaagcacgcagcaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctccccaataaagctaaaactcacctgagttgtaaaaaactccagttgacacaaaatagactacgaaagtggctttaacatatctgaacacacaatagctaagacccaaactgggattagataccccactatgcttagccctaaacctcaacagttaaatcaacaaaactgctcgccagaacactacgagccacagc

SEQ ID NO: 13130 - DNA, 558 bp, Homo sapiens
agatattttcctataattccagaatgtcttcagagagccgtgcatggattgcttcattaccttttccatacgagaaaccacaccttcattgtcctgcacctggtcttgcaagggatggtttatactgagtacacctgggaagtatttggctactgtcaggagctggagttgtccttgcattaccttcttctgccctatctgctgctaggtgtaaacctgttttttttcaccctgacttgtggaaccaatcctggcattataacaaaagcaaatgaattattatttcttcatgtttatgaatttgatgaagtgatgtttccaaagaacgtgaggtgctctacttgtgattaaggaaaccagctcgatccaagcactgcagtgtgtgtaactggtgtgtgcaccgtttcgaccatcactgtgtttgggtgaacaactgcatcggggcctggacatcaggtacttcctcatctacgtcttgaccttgacggcctcggctgccaccgtcgccattgtgagcaccacttttctggtccacttggtggtgatgtcagatttata

SEQ ID NO: 13131 - DNA, 579 bp, Homo sapiens
ggctctttcccatcttgcaagatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccgggtggttaaacttcgcaaaatgcctagatattatcctactgaagatgtgcctcgaaagctgttgagtcacggcaaaaaacccttcagtcagcacgtgagaaaactgcgagccagcattacccccgggaccattctgatcatcctcactggacgccacaggggcaagagggtggttttcctgaagcagctggctagtggcttattacttgtgactggacctctggtcctcaatcgagttcctcta

SEQ ID NO: 13132 - DNA, 595 bp, Homo sapiens
caagtcgcagcagtactagcccaagcatcatcaatgaagatgtgattattaacggtcattctcatgaagatgacaatccatttgcagagtacatgtggatggaaaatgaagaagaattcaacagacaaatagaagaggagttatgggaagaagaatttattgaacgctgtttccaagaaatgctggaagaggaagaagagcatgaatggtttattccagctcgagatctcccacaaactatggaccaaatccaagaccagtttaatgaccttgttatcagtgatggctcttctctggaagatcttgtggtcaagagcaatctgaatccaaatgcaaaggagtttgttcctggggtgaagtacggaaatatttgagtagacggggccctcttttggtggatgtagcacaatttccacactgtgaaggcagtattagaagacttaattgtaaaagctctcttgtcactgtgttacacttatgcattgccaaagtttttgttagtcttgcatgcttaataaaagtgctgagactgttactaagtaaaaagctgtcaaacatttactgaaaatagaattggccccatagcttgatgtga

SEQ ID NO: 13133 - DNA, 504 bp, Homo sapiens
  misc_feature 66: n = A,T,C or G
ctgggtagatgctcatatgaactgtgaagatattgccatgaacttcctggtggccaacgtcacggngaaaagcagttatcaaggtaaccccacgaaagaaattcaagtgtcctgagtgcacagccatagatgggctttcactagaccaaacacacatggtggagaggtcagagtgcatcaacaagtttgcttcagtcttcgggaccatgcctctcaaggtggtggaacaccgagctgaccctgtcctgtacaaagatgactttcctgagaagctgaagagcttccccaacattggcagcttatgaaacgtgtcattggtggaggtctgaatgtgaggctgggacagagggagagaacaaggcctcccagcactctgatgtcagagtagtaggttaagggtggaaggttgacctacttggatcttggcatgcacccacctaacccactttctcaagaacaagaacctagaatgaatatccaagcacctcgagctatgcaacctct

SEQ ID NO: 13134 - DNA, 553 bp, Homo sapiens
acagaagggactttgcgggcggcactttttccaggttgttaatccagctaatggagaaggatagatgcacgctacttggtttagaaaaaaaaacaaaaatgagcaaacgagacgccccttccgttttatgataactaagctgcagggaaataaatcggctggccctactgcaatctactgcactcgagaaacatcacagaaaattctttgatttatcttaatagtgacaagtgagcctgcctctgtcaattactgaagctataaggagattttttaaaaattaaacttcaacacaatgaggtgttgccacatctgcaaacttcctgggagagtgatggggattcgagtgcttcgattatctttggtggtcatcctcgtattattactggtagctggtgctttgactgccttacttcccagtgttaaagaagacaagatgctcatgttgcgtagggaaataaaatcccagggcaagtccaccatggactcctttactctcataatgcagacgtacaacagaacagatctcttattgaaacttttaaatcattat

SEQ ID NO: 13135 - DNA, 583 bp, Homo sapiens
ggattggtgggaaggggattggggtggggcaggctggcttaatgtaatatgagcaaccaaagtgggacttctgtctccccgctatattcccattgctctgaatggttgattgaagggtcagggaactagattttatggctttagttcactgtgattgtacatttatacttggcctatgtgctggccgcacctgaacatagctggtgcttatgccgagttatttgcgatgagtaaatatttagtttctttttcttcatatttataatgttgatctggcatcctcaggctgcagctttattagcttataacttactcatctctatctttaccagcaggctctgtattgttgatatttgcaacttgttttgcttttccattggtggaattgaaataattagtttttaattacataagatgcctgtttgctatttggtggaagatagatgttcatattgaagcagtcacatttgtactgtagttcaataaaagagaaatgaagtattctgtagcctatatttttcatagagctcatgagcatttactgtacttgctgggtcttgccaagatcatttattccgctgca

SEQ ID NO: 13136 - DNA, 477 bp, Homo sapiens
ggatctaagctataaccacttgaccttcattccagaagaaatccagtatctgagtaatttgcagtactttgctgtgaccaacaacaatattgagatgctaccagatgggctgtttcagtgcaaaaagctgcagtgtttacttttggggaaaaatagcttgatgaatttgtcccctcatgtgggtgagctgtcaaaccttactcatctggagctcattggtaattacctggaaacacttcctcctgaactagaaggatgtcagtccctaaaacggaactgtctgattgttgaggagaacttgctcaatactcttcctctccctgtaacagaacgtttacagacgtgcttagacaaatgttgacttaaagaaaagagacccgtgtttcaaaatcatttttaaaagtatgctcggccgggcgtggtggctcatgcctataatcccagcactttgggaggccaagatgggcggattgcttg

SEQ ID NO: 13137 - DNA, 116 bp, Homo sapiens
gttctgggcctagttgtcctccctctggagccccgtcctgtggtctgcctcagtttcccctcctaatacatatggctgttttccacctcgataatataacacgagtttgggcccgg

SEQ ID NO: 13138 - DNA, 397 bp, Homo sapiens
tccaccgcggtggcggccgctctagaactagtggatcccccgggctgcaggaattcggcacgagaagatattcacgttgaaacagatttcctgttcgtcttatgtgtctggtaaaattgtttccccaattacaatttgacatatcaatagagggttaacaagagtataattacataacagaattcctcatgaactgtaatcagtctacaggaaaatcattattttatcttgatttgcagatgaatatactgctaagaaagggagcaactctgacctttgttaaagttgatcttttgtaattgaggtataaggtatgaaaagataaaaaaccgaaggccagagaatcaggaaatgaaagatagtatggactgaaggtaacaatattttaatgttatgc

SEQ ID NO: 13139 - DNA, 615 bp, Homo sapiens
cggcacgaggtttttttctgcccaatttcattattggggtgtgaatccttgttgatgtttactgtctatttattttgaagatactaatcctatatttttgtaagtcaatgtcctccggccaggactacaagaaaccaactttaattaagcaagttggttttattactcagtcatgagttatggagaatttcagggcatctcagcacgaggatgttaggaagatcctatacagattttgggcttttatttggggattttggaaagggttgaaggaagcaggctttgctccagactgaatgctgcaggaagatactcagtacagtgagtatattttatatatcttttgtatagggaggacaggtgagagagatactaaagctgtaattggtcaagaagtagcagctatagtactggtataaagatagatacatcgacctgtctctattctggaacagaacaaacccttgcgtgtggagtcctaattagggaaaaggagtcaggctggctggacgaagggaagcaaaaggagaaagcagacaagccataagtctgcctttcttcgtggtccaggacacatagccctgctgtgcaaataactcacaatctgcctgtgcc

SEQ ID NO: 13140 - DNA, 636 bp, Homo sapiens
gacagagggggggcggagaacaaggagagggaagctggaagcacctttggcccgggacagaaatctggagagcttggctacctccatcctcctcaggccggagcaggcctcctgagagagtccaggtcgtaggagttttacgacttagaaaagcgggctgcagattccttcctgggtgtctggttcaagccttggctccagcctcactctcagtcttcccgggagttcgtgggatttggaccttagattattagtattattttgagggcctcctgtgtgtaagcactggttgtgcgcagatggctgtgcagagggccatgaggtagaggctggggaaatgagggcttggaggtgcttgaggtatggtctttacctacgtgaaatgttggaggttgagatgaaaactcttgctttgaattcttcatggaggactacatcatttcaatcctgaatctggctcaattctattattcacttattactgtattaaaaacgtttaattggccaggcacagtggttcacgcctgtaatcccagcactttgggaggccaaggcaggcggatcacttgaggtcaggagttcgacaccagcctggccaacatggcaaaaccccgcctctactaaaatacaaaatta

SEQ ID NO: 13141 - DNA, 618 bp, Homo sapiens
  misc_feature 458: n = A,T,C or G
acagagggggggcctccgccaccatcttgctttcctttaatccggcagtgaccgtgtgtcagaacaatcttgaatcatgaagctactaaccagagccggctctttctcgagattttattccctcaaagttgcccccaaagtcaaagccacagctgcgcctgcaggagcaccgccacaacctcaggaccttgagtttaccaagttaccaaatggcttggtgattgcttctttggaaaactattctcctgtatcaagaattggtttgttcattaaagcaggcagtagatatgaggacttcagcaatttaggaaccacccatttgctgcgtcttacatccagtctgacgacaaaaggagcttcatctttcaagataacccgtggaattgaagcagttggtggcaaattaagtgtgaccgcaacaagggaaaacatgacttatactgtggaatgcctgcggngtgatgttgatattctaatggagttcctgctcaatgtcaccacagcaccagaatttcgtcgttgggaagtagctgaccttcagcctcagctaaagattgacagagctgtggcctttcagaatccgcagactcatgtcattgaaaatttgcatgcagcagc

SEQ ID NO: 13142 - DNA, 556 bp, Homo sapiens
gacagagggggttgcccgcctggcccctgacggagtccttagccaggatggaggctgttgtgaacttgtaccaagaggtgatgaagcacgcagatccccggatccagggctaccctctgatggggtcccccttgctaatgacctccattctcctgacctacgtgtacttcgttctctcacttgggcctcgcatcatggctaatcggaagcccttccagctccgtggcttcatgattgtctacaacttctcactggtggcactctccctctacattgtctatgagttcctgatgtcgggctggctgagcacctatacctggcgctgtgaccctgtggactattccaacagccctgaggcacttaggatggttcgggtggcctggctcttcctcttctccaagttcattgagctgatggacacagtgatctttattctccgaaagaaagacgggcaggtgaccttcctacatgtcttccatcactctgtgcttccctggagctggtggtggggggtaaagattgccccgggaggaatgggctctttccatgccatgat

SEQ ID NO: 13143 - DNA, 449 bp, Homo sapiens
gttcatccagcctgagtgctctgagcctcgatgagccatttatacagaaagatgtggaattaagaataatgcctccagttcaggaaaatgacaatgggaatgaaacagaatcagagcagcctaaagaatcaaatgaaaaccaagagaaagaggcagaaaaaactattgattctgaaaaggacctattagatgattcagatgatgatgatattgaaatactagaagaatgtattatttctgccatgccaacaaagtcatcacgtaaagcaaaaaagccagcccagactgcttcaaaattacctccacctgtggcaaggaaaccaagtcagctgcctgtgtacaaacttctaccatcacaaaacaggttgcaaccccaaaagcatgttagttttacaccgggggatgatatgccacgggtgtattgtgttgaagggacacctataaacttt

SEQ ID NO: 13144 - DNA, 238 bp, Homo sapiens
gatgttgggtaagtcaagggatagtttaataagatttaactgagctcaaagtagtacaaaatggatatgatttatttcctatagagcattaatttaatggtggtataatttaaatgagaaggaatatccccaaacccagattttattttcttttaaaacatttgcaaaatatttcttcagaattttatactctaaaactgttttctaaaagaaaaaattctccagtcatgatctgaat

SEQ ID NO: 13145 - DNA, 523 bp, Homo sapiens
aactgctgttagacactactgtagggtgatctatacgaaaactataccatgatactctgaagcgctgcattcatatgtattccttcatggtctaaaacaactgagcatgtcctccaaataatcttaacatttagtacactttgaaactactcacctatcaaatttttgcttaaaaaacagattgccggccaggtgctgtgcctactcatgcctgtaatcccagtactttgggacgccaaggcacgaggattgcctgaccccaggagttcaagaccagcctggccaatatggtgaaaccctgtctctactaaaaatacaaaaattagctgggtgtggtggcagacgtctgtagtctcagctactcaggaggttgaggcacaagaattgcttgaaactgggaggtacaggttgcagtgagccgagattgtgccactgcactccagcctgggcgatagagggagactctgtctcaaaaacaaacaaaaaaacccagactgccatcattacatattctatgcatgta

SEQ ID NO: 13146 - DNA, 191 bp, Homo sapiens
agctaaaatggaccaattccttgcaagacgcattctctcaaagctcacacaagatagacctcaataggcatatgtatctattaaataaaccaaagcagtaattaataaccttccaaggccaggtacagtggttcatgcctgtaatcccagcacttcactttgggaggctgaggcgggtggatcacaaggtc

SEQ ID NO: 13147 - DNA, 585 bp, Homo sapiens
gggccatgaacagtgtgggggaggcatgcacggacatgaagcgcgagtacgaccagtgcttcaatcgctggttcgccgagaaatttctcaagggggacagctccggggacccgtgcaccgacctcttcaagcgctaccagcagtgtgttcagaaagcaataaaggagaaagagattcctattgaaggactggagttcatgggccatggcaaagaaagcctgaaaattcttcttgaccttgacagtcaccttgaaggatttcgcaagtccagaaattgaggactctggatttttgtcaactaactctgtgaacatagccatcagatttgatgaggaacttaggagagaggagttttatttcctccttcgatgttttcctctcagttgtaaaagatgaactctttgagatgatttctcacctgctgtggtatcttgcaggaactgtgtgctaaaattgaacaatttttttgagattatggttgcaatacttggcgtggaatcagctttacataaatataccttgtatgcaaacgatgataaactagtcaggatgagcagagctgcctgacctcttgatttctgctgc

SEQ ID NO: 13148 - DNA, 139 bp, Homo sapiens
gaacaccgaatagaaggccgggcacagtggctcacgcttgtaatcccaacactttgggagaccaaggtgggtgatcacctgaggtcaggagtttgagaccagcctggccaacttagtgaaaccctgtctctactagaaa

SEQ ID NO: 13149 - DNA, 329 bp, Homo sapiens
gtatctattaaataaaccaaagcagtaattaataaccttccaaggccaggtacagtggttcatgcctgtaatcccagcacttcactttgggaggctgaggcgggtggatcacaaggtcaggagttcgagaccagcctggtcaacatggtgaaaccccctatctactaaaaatacaaaaaattagctgggcatggtggcatgcgtgtgtagtcgaagctactcaggaggctgaggcagaagaatcacttgaacctgggaggtggatgttgcagtgagctgagattgtgccactgtactgcagcctgggtgacagaatgagactgcatctc

SEQ ID NO: 13150 - DNA, 470 bp, Homo sapiens
  misc_feature 177: n = A,T,C or G
gtacctgcctagcaacagtattctcattcctaaagaggttaatatgcagatctggcagaggacggaaattaagtggagaccaaataactttgccaactacagttgattattcatcagttcctaagcagacagatgttgaagagtggacttcctgggatgaagatgcacccaccagtnttaaagatcgaaggagggaatgggaatgtggcaacacaacaaaattctttggaacaactggaacctgactattttaaggacatgacaccaactattaggaaaactcagaaaattgttattaagaagagagaaccattgaattttggcatcccagatgggagcacaggtttctctagtagattagcagctacacaagatctgccttttattcatcagtcttctgaattaggtgacttagatacctggcaggaaaataccaatgcatgggaagaagaagaagatgcagcctggca

SEQ ID NO: 13151 - DNA, 529 bp, Homo sapiens
gacagagggggctgaaggagtctcgctgagctcgaggaggtggcgcgatggagggactggaagagaatggaggtgttgtccaagttggagaattgttaccttgcaagatttgtggaagaacattctttccagtagcattaaaaaaacatggacccatttgccagaagactgcaactaaaaaacggaagacttttgattcaagcagacagagagctgaaggaactgatattccaacagtaaaacctctcaaaccgaggccagaaccaccaaagaaaccatctaattggagaaggaaacatgaagaattcattgctaccataagagcagctaaaggccttgatcaggccctcaaagagggtggcaaacttcctcctcctcctccaccttcttatgatcctgattatattcaatgtccatattgtcagaggagattcaatgaaaatgcagctgatagacatataaatttctgtaaagaacaggcagcacgtattagtaataaagggaaattttctacagataccaaaggaaa

SEQ ID NO: 13152 - DNA, 450 bp, Homo sapiens
gacctaagaaaagctggattgctgatttttgctaataaacaagatgttaaagaatgcatgactgtagcagaaatctcccagtttttgaagctaacttctattaaagatcaccagtggcatatccaggcatgctgtgctctaactggcgagggattgtgccaaggacttgaatggatgatgtcacgacttaagattagatgatctctactgacctcttctcatagattttgtataaatgaagtgctggactttacctgaaagctgcaaaaattaatggtttagatatatttataataaactgatttaaactttttctataagaagaaaaattaagaccacttatttgaaaacaaagatgaagtctcaccttccagtttgctttctcattagttttttccaaagtaagttattgaagctgtgattgacatttttctcataatgaatcctctc

SEQ ID NO: 13153 - DNA, 302 bp, Homo sapiens
gagacagagtctcgttctgtcgcccatgctggaatgcagtggcacgatcttggctcactgtaatctccgcctcccgggttcaagtgattcttgtgcctcaccacgcccagctaatttttgtatttttagtggagagggaatttcaccatgttggccaggctcatctcgggttcctggcctcaagtgatctgcccacctctgcctcccagagtcctgggattacaggtgtgagccaccacacttagctgtatacagctcaccataataaataaataatacataaaaatccataatgaatcctc

SEQ ID NO: 13154 - DNA, 496 bp, Homo sapiens
aaagaaatagtgggggacaaagaatcccttcctaatttccctgcagtcccatcataggcatgaccatcgcatctctttatggctgaagcttagcctgactgctggacccagacttttgcccagtgacctctggggtaggttactatcctctttgtcctgccagtacccctagaggtttgacttaattgctgcatctagggacttagggatttttcccaaatgctgtgtagaaagtcactggagttaaatctactccaaccatttttctgctgtttcttgaaaagacaggatgattcatttacatctcttttccttcacagaatcatgagggaagtattgtgattaccagtgttaagcatttgtgaatattttattccaaaaagaaaaaaaatcactttaccagccttttctgcagagataaagactggaggtcaggtgcggtggctcatgcctgtaatcccagcactttggaaggctgaggcgggcagatcacctg

SEQ ID NO: 13155 - DNA, 570 bp, Homo sapiens
gaactgaaagcgatgaaaagcgttccacacgccacgagcccgcgggatcctcggagagtatggaacccttcccctccgctctcagccggaggccagctgcgtccagccgggctcggtcttctgaacaccgatttcaaatcaggtccccggggcccagcgtcacttagggaagtggtggcattttgtggttgctgctaaatcacggagagcagccttggcgctgccggtcccaacttgatccaaggagccttgagaaggagatgagattcagtaccaggggccggccgtggctcccatcctccggaatctgcaaaatggctacttcttcagaaataatggggagagggatggcaagaggccagagatcaaggccctcgagtattaacttgagcatttgggcacaaaatagacacttttggattttcccgtcttttccaacaccaaggatgagattatcaaaagatgtgttaaattaatttgtaccggccgggcgcggtggcttacgcctgtaatcccaacactttgggaggccgaggcgggcgaatacaaggtcatgagttcgaaaccagc

SEQ ID NO: 13156 - DNA, 202 bp, Homo sapiens
agcttgcggccgcggtttttttttttttttttttcggattaaaccggttaaaaaaaccccgtccggggaaaaaaggaccccttaaacccgggcccaggggggcacatttacagccccatttatttggaaggttaaaccaggagaataatttaaccccaagaggtttaatcccatttgggccaacaaagaaaaaattttgttt

SEQ ID NO: 13157 - DNA, 414 bp, Homo sapiens
tcggcacgaggcctcgtgccggaaagtcttatctttgccagcctcaaaaataggtcaagaagaaacagtctctcggtttacagttggacagttgtagcctcaagaacaaatgaggtattaatattagctaggaatctctgacaaggaccagaacttgcatcctcagatatcttcagtgttgtgggtcttcagcacagccttgaagataattcctaaaaaggctcagtccacaaaaatatcaccaacttcaaaacaaattcacatcacatcattattgctcaggaacaaatgcttcagataaaagtagaaaagccagataactcaaactacagaggaagaaatgagacctcaaacttttgctgccacttgggaacaacatttttttttttagatagggtctcactctgtcaccca

SEQ ID NO: 13158 - DNA, 550 bp, Homo sapiens
ggcagaagcggctcgaggctggaagaggatcttgggcgccgccaggttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcgatttcaacgacgtcacaacccgcttgagggaaaatgagctaacgtactactgctgcaagaaggacctgtgtaactttaacgaacagcttgaaaatggtgggacatccttatcagaaaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggaccct

SEQ ID NO: 13159 - DNA, 329 bp, Homo sapiens
gacaataagatggactagagttcgacaaaatgatttctttatttaaattttgtataagtattttcttcgacactttcaaattatattgtgttcttgatatatgctgtatatttatttgttagtgcatgtgtttttaatttacatgaaaacatgagttaggagaaattacaggttgaaagatgaaatgcctgtatgtgctctgaagaaatggtaattccagattgtgcagggggaaacaaatctattttgttttgttttgttttttgagacggagtcttgccctgtggctgggctggagtgcaatggcgcgatcttggctcactgcaacc

SEQ ID NO: 13160 - DNA, 538 bp, Homo sapiens
gacagaagggtgcctcttgccaaagcagcacccaaatctggtccttctgttcctgtctcagtacaaactaaggatgatgtctatgaggctttcatgaaagagatggaagggctactgtgacagcttttgatgccagaaaaggcttctgttcacaacagtggcccatggagaaagaggctcttattaaacttagatgaaagagctgcttccattgtcagggtattttctaatttcagttcaaggaatatcctaaaatttagccttgttcagaatttactgcacataaaaaagggtatttcatccagaatagatcagttattgaagcagtgctgctaacatccattccctttcataccaccattttcaccctgtttcttcccctcctccagttctttggaaatttgtgatcgggggatcttagttgcttatttgttttgactcttgtgtgctgtgggcactggagtagagatttctggagaaaaaaaaacagtttatttcatcttgccttttgtgtttgagttatttttaatattttcct

SEQ ID NO: 13161 - DNA, 563 bp, Homo sapiens
taaggaatgccaaaggctccaaaaacaaataaacaaactttcagatcaatcagctaataataataatgtcttcacaaagaaaacggggaatcagcagaaagtgaatgatgcttcagtaaacacagacccagccacttctgcctctactgtagatgtaaagccatcaccttctgcagcagaggcagattttgacatagtaacaaaggggcaagtctgtgaaatgaccaaagaaattgctgacaaaacagaaaagtataataaatgtaaacaactcttgcaggatgagaaagcaaaatgcaataaatatgctgatgaacttgcaaaaatggagctgaaatggaaagaacaagtgaaaattgctgaaaatgtaaaacttgaactagctgaagtacaggacaattataaagaacttaaaaggagtctagaaaatccagcagaaaggaaaatggaaggtcagaattcccagagtcctcaatgtttcaaaacatgctcagagcaaaatggttatgttctcacattgtcaaatcacaaccagttctgcaatatggtaatccttatgcatc

SEQ ID NO: 13162 - DNA, 447 bp, Homo sapiens
acagaagggagatgttgggccttttggatagattctgtgagtccttctttctacctttgcttgtagataagattttccttgaatacaaacacacacactctctctgctttttaaaaaattagttttggggctggatgtagtggcttacacctgtagtcccaggcactttgggaggccgaggcaggcggatcacttgaggtcaggagttccagaccagcctggccaacgtggtgaaaccccgtctctactaaaaatacaaaaagtagctgaatgtggtggtgtgcacctgtagtcccagctgctcaggaggctgaggcaggagactggcttgaacccgggtggcagatgttgcagtgagccgaaatcacaccactgtactccagcctggtgacagagccagactgttttaaaataaataaaaataaaaaattggttttggattttaaa

SEQ ID NO: 13163 - DNA, 445 bp, Homo sapiens
ggcagagtcgagagtgggagaagagcggagcgtgtgagcagtactgcggcctcctctcctctcctaaccccgctctcgcggcctacctttacccgcccgcctgctcggcgaccagaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctctagtactttacagtctgagggttccaacagtgacatgtatctcgtgcctgctgccatttttcgggaccccttccgtaaggaccctaacaagctggtgttatgtgaagttttcaagtacaatcg

SEQ ID NO: 13164 - DNA, 632 bp, Homo sapiens
acagaaggggcagatggttactctgttctggaatgggactctgcagctctatgcagtggccaacattctgagcactttgtgcaaatgcttgtagagctcaagaacgtctccatccagaaccccttccccatctgcagagaccatgtccaggcctttcttgtgtctgcagaggtgaagtgcacatgtggaaagggatcaaatgtagcacagtgtaaagaaagacagcaacacaggtagagggacccagtgtgtgctgggaggtggctgtggaaggtaagtatagacctacatctctgttggggaggtggtcagggcagaatggcctgggtgtttagcagcttctaggggtgagggtggcaggaccccaaaaccaaggccctctgcatcgttgttgtaataatcagctctggcatattcagctgcaactgtccctgaagaagaggtttctgagctggctgaccccatgtaggagggtgttaccttgtagaaaaagctggagggacctggtgggacagtgcagtgaggcagggtagaaatggtcagttgtttagggccagtggccacataccaaaataccaccaatgtgcccagggccaaactgccttaattctgagtgctgtgtgttctgcagg

SEQ ID NO: 13165 - DNA, 304 bp, Homo sapiens
atcatctctgctaaccagctagtagctaaccagctgaaggaggaatttagagtaagctagacatttctatctgctgaacttttatttagtccttgtgtgacttctgaacttttgcaatgaaaaaaattactggccaggcatggtggctcgttcctgtaatcccagaactttgggacgctaaggcaggtggatcacttgaggccaggagttcgagaccagcctggcccacactgtgaaactctgtctctactaaaaatacaaaaattagctgagcgtggtggtacatgcccataatctcagctac

SEQ ID NO: 13166 - DNA, 112 bp, Homo sapiens
atggagtgagagagagagagagagagatatgacaaggagcacaagaagtggtccatctcccgaattcgctgttaccgcctgtctctttaagggcatgccttgtgctgttaat

SEQ ID NO: 13167 - DNA, 624 bp, Homo sapiens; identical to SEQ ID NO: 2344

SEQ ID NO: 13168 - DNA, 530 bp, Homo sapiens
acagaagggataatcctttaagatatgaatgtatcttttaagaaacatattaaagtatatcaattctgtcattacaaattctttgacagaatctcttcaaataaattagaggaagcatctgggcattattttataaagcattttacgagcacatatagcaaactagatgaaatatttcatggaaaaacacatagaacgtgagttttatgtaaacaagaaatatttttcagtattccaaagtgctgggattacaggcgtgagccactgtgcccagccatctcttcttttaaaaatgattttgcatctgtacttctgtctgagttgcattaaattttgccagaattagacattttattgtgttaagcttttggaagggatgactgagctaacccccccctcttttttacttttaaacaaattttattttatttatttatttattttacctttgtcctgaactctcttacattgatgtgtcattatctatatatagagcactaaggtatactcttattggatgtgggaggatg

SEQ ID NO: 13169 - DNA, 627 bp, Homo sapiens
acagaagggatatgacctcattaaatgtgctgttttatttggaccagtcacacaaaatgtctctctagagttgactttaaagttgtttacagaaatttaaactcaattccagagattgaagttgtccaaacagctcatgggcttagtgtccaaacccctgcccagccttccctttccaagttggtgccacctccaggtagccattggtggttttcctattactgatgtggctgtggaatgataaggtcctagaggggccctggcatttcaggaagcggacctggtattccctgacaaacattgcttaggaaagagggccggagaataagaagccagcacctcatcagtcagccctgcaatgtgagacttccgtagctgttgagagtcactgcaggtgttctttcatcccgtctgattttaacccatggttgagacgttccaagttagatctgctgctcttaggtgtggggctgtccacattagggaacttgcctcaaaaacagtccacagtggcaataccggacttctgttcaagctttttaaagtgctgagtcttacaaacccctgaaggaaggtgaccctttaagagaggatcatctttttttatatttattttcaccaaatagg

SEQ ID NO: 13170 - DNA, 193 bp, Homo sapiens
tacggctgcgataagacgacagaagggtacggctgtgagaagacgacagaagggtactgctgcgagaagacgacagaagggtacggctgcgagaagacgacagaagggtacggttgcgagaagacgacagaagggtactgttgcgagaagacgacagaagggtacggcctgcgagaagacgacagaagggtac

SEQ ID NO: 13171 - DNA, 476 bp, Homo sapiens
acagaagggtcaggtatttaatcttcgtttccgtatctgagtaaatggtgctgataaacatgcatactctcttggaatgtggtaataactaagtgcccgagtgaatgaccactctcaaaaattggtacattatcttatgattctagtgatatcagattttctcatgttttgttttgtgttgtttgtttttgggtttgtgtatatttccaatctttttattttagaagatattgatgctgatggacagggattttgtcaaggaggattcagcattgattttactaaagctgacagagtacttcttggtggtcctggtagcttttattggcaaggtaggttaatattttttaaattacaattggtgactatgtgtcgctgattcacctggctaattgtatgcctatgacattttacaaattattttaaagaaagaaatggaaatacaattaaagtatataaacactccattttacaca

SEQ ID NO: 13172 - DNA, 662 bp, Homo sapiens
tcggcacgagggtggtcactgggcacttaacgccatacttcctgactgtgtgcaagccaaactacaccagtgcagactgccaagcgcaccaccagtttataaacaatgggaacatttgtactggggacctggaagtgatagaaaaggctcggagatcctttccctccaaacacgctgctctgagcatttactccgccttatatgccacgatgtatattacaagcacaatcaagacgaagagcagtcgactggccaagccggtgctgtgcctcggaactctctgcacagccttcctgacaggcctcaaccgggtctctgagtatcggaaccactgctcggacgtgattgctggtttcatcctgggcactgcagtggccctgtttctgggaatgtgtgtggttcataactttaaaggaacgcaaggatctccttccaaacccaagcctgaggatccccgtggagtacccctaatggctttcccaaggatagaaagccctctggaaaccttaagtgcacagaatcactctgcgtccatgaccgaagttacctgagacgactgatgtgtcacaagctgttttttaaaatcatcttccaattctatacttcaaacacacagttgctcaatgtcaaactgtgatgacaaatattacgtttatctagtt

SEQ ID NO: 13173 - DNA, 498 bp, Homo sapiens
gcgccgctccaacatcaccaagatgtggcttctgcagctccagaaaaagcagagaaccctgctggccatggtccaaggaggtgaaaggcaaaactcacacttactatcaggtgctgattgatgctcgtgactgcccacatatatctcagagatctcagacagaagctgtgaccttcttggctaaccatgatgacagtcgggccctctatgccatcccaggcttggactatgtcagccatgaagacatcctcccctacacctccactgatcaggttcccatccaacatgaactctttgaaagatttcttctgtatgaccagacaaaagcacctccttttgtggctcgggagacgctaagggcctggcaagagaagaatcacccctggctggagctctccgatgttcatcgggaaacaactgagaacatacgtgtcactgtcatccccttctacatgggcatgagggaagcccagaattcccacgtgtactggtggcgct

SEQ ID NO: 13174 - DNA, 153 bp, Homo sapiens
ctgaagtgggagctgacttctctgttgcaccttcaccctacttagggacactaagggttcctgcctggagaatgaaaacaactccttagatctaatcgttttatttgttagtttaggacattcctccagaatacattaaagtggctttcttca

SEQ ID NO: 13175 - DNA, 650 bp, Homo sapiens
  misc_feature 552: n = A,T,C or G
tccaccgcggtggcggccgctctagaactagtggatcccccgggctgcaggaattcggcacgagaagatattcacgttgaaacagatttcctgttcgtcttatgtgtctggtaaaattgtttccccaattacaatttgacatatcaatagagggttaacaagagtataattacataacagaattcctcatgaactgtaatcagtctacaggaaaatcattattttatcttgatttgcagatgaatatactgctaagaaagggagcaactctgacctttgttaaagttgatcttttgtaattgaggtataaggtatgaaaagataaaaaaccgaaggccagagaatcaggaaatgaaagatagtatggactgaaggtaacaatattttaatgttatgcaatatagccagagaaatattaaaaattagttgtttgctgtgcataggtggatctcgcaggaagctaatgaaacctaagcttcagtgcctctcacttagacatgttccattcgaggtcctgaacctaactttgtattaggaattctgtactaattntgttgaagaagaccagcaaagttgtgtacacttctacccccacaaaatctgcattgaccatgtgagtaaagtaaaataattcctgttatttttttctg

SEQ ID NO: 13176 - DNA, 93 bp, Homo sapiens
tttgttcacagggaggcaaagctgacatgaaccttttgtcgtgggacttcaggccacattggcttgaaggcattcgtttccttcttggctctg

SEQ ID NO: 13177 - DNA, 528 bp, Homo sapiens
ggtgggaagagttagggccagtggtcttgaaaatcaatcaagtagtgaatgtgatctctttgcagagctatagatagaaacagctggaaaactaaaggaaaaatacaaatgttttcggggcatacattttttttctgggtgtgcatctgttgaaatgctcaagacttaattatttgccttttgaaatcactgtaaatgcccccatccggttcctcttcttcccaggtgtgccaaggaattaatcttggtttcactacaattaaaattcactcctttccaatcatgtcattgaaagtgcctttaacgaaagaaatggtcactgaatgggaattctcttaagaaaccctgagattaaaaaaagactatttggataacttataggaaagcctagaacctcccagtagagtggggatttttttcttcttccctttctcttttggacaattgttaaattagcagtattagttatgagtttggttgcagtgttcttatcttgtgggctgatttccaaaaaccacatgctgctga

SEQ ID NO: 13178 - DNA, 289 bp, Homo sapiens
gatctcggctcactgcaagctccgcctcgcgggttcacgccattctcctgcctcagcctcccgagtagctgggactacaggcgcccgccaccacgcctggctaattttttgtatttttagcagagacagggtttcactgtgttagccaggatggtctcaatctcctgaccttgtgatctgcccgcctcggcctcccaaagtgctgggactacaggtgtgagccaccgcgcccggcctcagcgaagttgattgatccaccatctcattagtttaaatctgccatctgatt

SEQ ID NO: 13179 - DNA, 380 bp, Homo sapiens; identical to SEQ ID NO: 2367

SEQ ID NO: 13180 - DNA, 435 bp, Homo sapiens
gatttttgtttggccttgcattgccttggtaaagtaaaaggaaacagtacacttggagctaggaaaccaaagcaagctttgtgaaactggcacagtgatagagaattgctgtggagagttatagagcaaagggatgggtccttgaggcctgccagtgtgtaaaggtgttcaaataaagggctgtttctacaggtaacattaaatgtgaactcaacacttccagagtctttaaagggtttctatgtgtatcagtgtaatagtgttttaccaccaactgcctttctttgttcctagttactgtaacaaatatttgatgatagaggtttattaattttgtttatccagaccattaattttatttgtttttgttctatgtaatcaaataaaatttgagtaacatgtaatggtaaggattaatgcatggttatttggacc

SEQ ID NO: 13181 - DNA, 541 bp, Homo sapiens
acagaagggattccaagttgataactcttccatgtttcacatttctaaatttaacagagatgctgtagcttaaaacatgttttgataagtaattacactggacctaggcaaaaccactgaagaacaagtgttcctttttaccacatacatattatgttttgatcactgctgcttgagccccgctattggtataattcagatcattttagcttgttgctgaggatgtcacatataagacaggatcaaacctgaaagacactaatggttcatcctctataaggccaacaaagaaaacaaattaatgtgatgtaacttgcatttatgtgcactctgcataggtttcccaataatactgtaatgttgctgaacacctttccctgttttccatttatacacatattaaagtcatattgggaaagatggcaaagcttttgagaatataaacacacctgttttgtttttcttaagttcaacatacttttgtagaatttgtaaaataaatgttcgtatcataattgagaatttatagccaaggatcctc

SEQ ID NO: 13182 - DNA, 266 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgctagaagacacagaagggtacggctgctagaagacgactgaa

SEQ ID NO: 13183 - DNA, 472 bp, Homo sapiens
tgcctcaatattctttatctgcctcttcctacacatcgggcgaggcctatattacggatcatttctctactcagaaacctgaaacatcggcattatcctcctgcttgcaactatagcaacagccttcataggctatgtcctcccgtgaggccaaatatcattctgaggggccacagtaattacaaacttactatccgccatcccatacattgggacagacctagttcaatgaatctgaggaggctactcagtagacagtcccaccctcacacgattctttacctttcacttcatcttgcccttcattattgcagccctagcagcactccacctcctattcttgcacgaaacgggatcaaacaaccccctaggaatcacctcccattccgataaaatcaccttccacccttactacacaatcaaagacgctatctacgtagatccagacatgataagatacattgatgagttt

SEQ ID NO: 13184 - DNA, 581 bp, Homo sapiens
gggctgtgcagggcaggggaagctccaggcaaacagcccagcaaacagcagcactcagctaaaaggaagactcacagaacacagttgaagaaggaaagtggcgatggacctcatcccaaatttggcggaggaaacctggcttctcctggctgacagcctggtgctcctctatctatatgggacccgtacacatggactttttaagagactgggaattccagggcccacacctctgcctttgttgggaaatgttttgtcctatcgtcagggtctctggaaatttgacacagagtgctataaaaagtatggaaaaatgtggggaacgtatgaaggtcaactccctgtgctggccatcacagatcccgacgtgatcagaacagtgctagtgaaagaatgttattctgtcttcacaaatcgaaggtctttaagcccagtgggatttatgaaaagtgccatctctttagctgaggatgaagaatggaagagaatacggtcattgctgtctccaaccttcaccagcggaaaactcaaggagatgttccccatcattgcccagtatggagatgtattggtgagaaact

SEQ ID NO: 13185 - DNA, 423 bp, Homo sapiens
gctctgaagccattacaaaggttgcttaacttctaattatttgatcactgaggaaaatccagaaagctacacaacactgaaggggtgaaataaaagtccagcgatccagcgaaagaaaagagaagtgacagaaacaactttacctggactgaagataaaagcacagacaagagaacaatgccctggacatggctccagagatccacatgacaggcccaatgtgcctcattgagaacactaatggggaactggtggcgaatccagaagctctgaaaatcctgtctgccattacacagcctgtggtggtggtggcaattgtgggcctctaccgcacaggaaaatcctacctgatgaacaagctagctgggaagaaaagggctggagtacagtggcaagatctcagctcaccacagtcttgacttc

SEQ ID NO: 13186 - DNA, 70 bp, Homo sapiens
gaatatgcaactaggaaggggcagaatcagaatttaagctttcatattctagccttcagtcttgttcttc

SEQ ID NO: 13187 - DNA, 493 bp, Homo sapiens
acagagggggcccctcgaatggggctggcagcagctggaggagtggagcaccagcaactgttagacctcgcccagaagcacctcggcggcatcccatggacatatgcagaggacgctgtgcccactcttactccatgccgcttcactggcagtgagatccgccaccgtgatgatgctctacgttttgcccacgtggccattgcagtagagggtcctggctgggccagcccggacaatgtggccttgcaagtggccaatgccatcatcggccactatgactgcacttatggtggtggcgtgcacctgtccagcccactggcttcaggtgctgtggccggcggctatgccagagtttccagaccttcagcatctgctatgcagagacgggcttgctgggtgcacactttgtctgtgaccgaatgaaaatcgatgacatgatgttcgtcctgcaagggcagtggatgcgcctgtgtaccagtgccacggagagtga

SEQ ID NO: 13188 - DNA, 653 bp, Homo sapiens
acagaaagggatcccatccattttcaacactccagagccaacaacaacgcaagaacctttggtgggcagccaaaagagaaaagcaaggaaaaccaagattacacaccttgtcaggacagcagatggccgggtatcaccagcaggaggtactttggatgacaaaccaaaggaacaactgcagaggagtctccctaaagcaactgagacagactgcaatgacaaatgctcacacaacaccgaggtcggggagacgcggagcagtactccagaaatgcctgccgtgtctgcgttctttagcctcgctgcgctggctgaagtggcagccatggaaaatgtgcacagaggtcagaggtcaactccgctcacccatgatggacagccaaaagaaatgccgcaggctcctgtacttatttcctgcgctgaccagtgaagcgccctttcattgtaaaacattgtgctttacctactaccctagccttgtctttaccgagggatgctagtgagtccaagtggtggaaaatatagactgcaaacaagtgcttgttgccccacacggcccagattcacttgaagcagaagttagcatcctgggccagtttgttctctcagaacccagaatctttgagggtaaggttatctgtctgatactgagc

SEQ ID NO: 13189 - DNA, 557 bp, Homo sapiens
gctgccttcactaggatattgtgtagaatgtacctgaaacatgggagcccagttaaaatgatggagagttatattgcagttctcacaaaggggatatgccagagtgaagaaaacggctctttccttagtaaggattttgatgcccgaaaggcctacctggctggctccatcaaagacattgtatctcagtttggaatggaaactgttatcttacacacagcactgatgctaaagaaaagaattgtggtgtatcaccccaagatagaagcggtccaggagttcaccaggactctgcctgccctggtgtggcaccgacaggactggaccatccttcactcttacgtgcacctcaacgccgatgagctggaagccctgcagatgtgcacaggttacgtcgctggatttgtagacttggaggtgagcaacagaccagacctctatgatgtgtttgtgaatctggcagagagtgagattaccattgctccccttgcaaaagaggccatggcaatgggcaaactgcacaaagaaatgggtcagctaattgttcagtctgcaga

SEQ ID NO: 13190 - DNA, 348 bp, Homo sapiens
gagctactcgggaggctgaggcgggagagttgcttgaccctgggaggcggaggttgcagtgagccgagatcgtgccactgcactccagcctggccgatagaatgagactctgtctcaaaaaaaaaaaaaaaaaagaattaaaaaaaaaagactaaaaaattgtttgtcaaaattgtaacagtgttttgttttgggaaatgctaaaaatgtgtggggaattaattttttttccaaggccattgggcattttaaaatttttttataatttttttaccttatggtggaaataaaaaagccattaccaatccccattttttttttaaaaggaaaaattttagccaaggggaa

SEQ ID NO: 13191 - DNA, 509 bp, Homo sapiens
gaacatattatcaggaaaaaagatatcattgaaaaaattggaaaagtcaaagtctggccgggtgcagcggctcacatctgtattcccagcattttgggaggccaaggcaggtggatcacttgaggtcagagttcaagaccagccttgccaacatggtgaaacccacctctacttaaaaaaaaatacaaaaaaattagccaggcatggtggcacacacctgtaatctcagctattcaggagactgaggcaggagaatagcttgaaccaaggaggcgtaggttgcagtgagctgagatggagccaccacactccagcctgggcaacagagcaaggctctgtctcagagaaaaaaggccaggcgtgatgggtcatgcctgtagtcccagcactttaggaggctgaggtgggcggatcacctgaggtcgggagttcaagaccagcctgaccaacatggagaaaccctgtccctactaaaaatacaaaattagccgggcgtggtggcacatgcc

SEQ ID NO: 13192 - DNA, 301 bp, Homo sapiens
gaggctataacttgatctaccgatcaacaaggcatctcaagagacttgcgttgatgatacagtcctctggcaacacagtgcttctcctcatactgtgcatgcagcactccttcccagagcctggcagattgtatcttgacctcattctggccatcttggcactggaactcatctgttccctgaatgcctccgatttaacagtgaaaatccccaagatttaataaagctaaaccagagcctgatatacttgaagaagaaaaaatctatgcttaccccagcaatattacctcggagactggat

SEQ ID NO: 13193 - DNA, 521 bp, Homo sapiens
gtgattgttgctcacctgagtgtggctgattgtgtacatccagcagttacaatttttaaaaattatacttttacatttattttatatttttctcacccccagtaatttccttccaaagaagttcacatgtaataagtagaaattctgtataggaaaaaagcattaaaaatactattataactgcttcatttgctgggaaccattaaaagtaatataaattagctttttccagaaggatccttttgtagcagtgtttatgaatgtaacccccagcaaaatatggctatatattaggggagccagtttggagcagaggcctgaaggtccctgctatgcagccgtggccacagctcgcagcccaagcactgtggagcatccacacctttgatggcaatgcagattggtagcaggttccataggcgtacaaaacagtattaaagctcagtgttttgcatattgttagcatttacaaatatttctgctttagtatgaggaaagtaaggatgggcaaagaagtgatc

SEQ ID NO: 13194 - DNA, 596 bp, Homo sapiens
aggggggagttcaggaaatggaaggcgcaatgtttgagcaaagcggacctcagccggaagggcagtgttgacgaggatgtggtagagcttgtgcagtttctgaacatgcgagatcagtttttcaccaccagctcctgcgctggccgcatcctactccttgaccggggtataaatgggggggaggttcagaaacaaaactgttgctggctactggttacacacaaactttgtgtaaaagatgatgtgattgtagctctgaagaaagcaaatggtgatgccactttgaaatttgaaccatttgttcttcatgtgcagtgtcgacaattgcaggatgcacagattctgcattccatggcaatagattctggtttcaggaactctggcataacggtgggaaagagaggaaaaactatgttggctgtccggagtacacatggcttagaagttccattaagccataagggaaaactgatggtgacagaggaatatattgacttcctgttaaatgtggcaaatcaaaaaatggaggaaaacaagaaaagaattgagaggttttacaactgcctacagcatgctttggaaagggaaacgatgac

SEQ ID NO: 13195 - DNA, 535 bp, Homo sapiens
atttattcttgggtggccagttttgaaacctaaaaaggacaataaagcaaaaagtatcagtaaggataggtggctgagacccactgccctgagctactagtgtggctgtgcctgtgggtctctagaaccatctgcattggacgtgaagccacagcaggtggctggactgctggcctgttcctaatgagctacgctgggctttgagtagagttggggtttatgaaccccaactctggcttaaagatcttgctgtggctctgttatgttctgaggccttgggattagcctcttcctcattatggagctgattttctagtctgtggatcagctatgcctttggacacttctcttttccattgtgccttttgaatgttgtcttctcactcagcatcagcacttcgatctaaatgcagactaggtagttgggaggaggaaccaaagtgaaccatccttcatttattcagtcattcgttcatctgtcaaacacgtatttggacatcaaggttgcagagatgaacaatgcatggatttcatc

SEQ ID NO: 13196 - DNA, 521 bp, Homo sapiens
gacagagggggagatgatattcagatattctctcaaaggcaggactccaacaccgcaggtggaaaaccaacaaaaggaagaaaacagaaaggtgggggagataaggagtagccaggaaaaagaaaatagtgataaaggaagagccaaaaaggaggaaagggaagatgaaagaccgacttcaagaactaaagcagagaacaaaggaaattgaactctctagagacagtcatgtatcaactacagaaacagaggaacaaggggtgtttctacagcaagctgttatttatgaaagagagcctgtagctgagagacacctacatgaaatccaaaaactactggaagtattaacaatttggcagataatgttcaaaaatttgggcagcaacagaaaagtctggtggcttcaatgagaaggtttagtctacttaagagagagtctaccattacaaaggagataaaaattcaggcagaatacatcaacagaagtttgaatgatttagttaaagaagttaaaaagtcag

SEQ ID NO: 13197 - DNA, 598 bp, Homo sapiens
gagcttccgggtttcctgggctactacgatggcgatgagtttcgagtggccgtggcagtatcgcttcccacccttctttacgttacaaccgaatgtggacactcggcagaagcagctggccgcctggtgctcgctggtcctgtccttctgccgcctgcacaaacagtccagcatgacggtgatggaagctcaggagagcccgctcttcaacaacgtcaagctacagcgaaagcttcctgtggagtcgatccagattgtattagaggaactgaggaagaaagggaacctcgagtggttggataagagcaagtccagcttcctgatcatgtggcggaggccagaagaatgggggaaactcatctatcagtgggtttccaggagtggccagaacaactccgtctttaccctgtatgaactgactaatggggaagacacagaggatgaggagttccacgggctggatgaagccactctactgcgggctctgcaggccctacagcaggagcacaaggccgagatcatcactgtcagcgatggccgaggcgtcaagttcttctagcagggacctgtctccctttacttcttacctcccaccttt

SEQ ID NO: 13198 - DNA, 331 bp, Homo sapiens
cactgctgtctgtctgttccaccggatctaaccacagcacacgcgtggctcacggtactattgtgataaatgcttgctacatgaaggcgttaacagggatgataatagactttctggagaaacaaaaggactaacaatcacgaaggggaggtgatcggggcatgagtaaagtggacacctcagcaaagccattcgctgtgatctctgattgagcagtgacatgtcctgtcaccagagccccctcgtgtttgatgttggccaatgccgacagcatgatctagcaggccacatcctaatctaccattctctgacaccagctggtcccctgggt

SEQ ID NO: 13199 - DNA, 637 bp, Homo sapiens
  misc_feature 548: n = A,T,C or G
agaaaagcattgatgacttagaagagaaagtggctcatgccaaagaagaaaaccttagtatgcatcagatgctggatcagactttactggagttaaacaacatgtgaaaacctccttagctgcgaccacattctttcattttgttttgttttgttttgtttttaaacacctgcttaccccttaaatgcaatttatttacttttaccactgtcacagaaacatccacaagataccagctaggtcagggggtggggaaaacacatacaaaaaggcaagcccatgtcagggcgatcctggttcaaatgtgccatttcccgggttgatgctgccacactttgtagagagtttagcaacacagtgtgcttagtcagcgtaggaatcctcactaaagcaggagaagttccattcaaagtgccaatgatagagtcaacaggaaggttaatgttggaaacacaatcaggtgtggattggtgctactttgaacaaaaggtccccctgtggtcttttgttcaacattgtacaatgtagaactctgtccaacactaatntattttgtcttgagttttactacaagatgagactatggatcccgcatgcctgaattcactaaagccaagggtctgtaagccacgctgct

SEQ ID NO: 13200 - DNA, 653 bp, Homo sapiens
  misc_feature 567: n = A,T,C or G
cgtcgaccccgcgtccgaagcaccccgcacttctcgaagtctgagttacttggaatcgttttaccacatgatggacagaaggaatatttcagatatctctgaaaacctcaagcgttaccttcttcagtattttaagccagtgattgacaggcaaagctggagtgacaagggctcagtctgggacaggatgctccgctcggctctcttgaagctggcctgtgacctgaaccatgctccttgcatccagaaagctgctgaactcttctcccagtggatggaatccagtggaaaattaaatataccaacagatgttttaaagattgtgtattctgtgggtgctcagacaacagcaggatggaattaccttttagagcaatatgaactgtcaatgtcaagtgctgaacaaaacaaaattctgtatgctttgtcaacgagcaagcatcaggaaaagttactgaagttaattgaactaggaatggaaggaaaggttatcaagacacagaacttggcagctctccttcatgcgattgccagacgtccaaaggggcagcaactagcatgggattntgtaagagaaaattggacccatcttctgaaaaaatttgacttgggctcatatgacataaggatgatcatctctggcacaacagctc

SEQ ID NO: 13201 - DNA, 526 bp, Homo sapiens
tcggcacgaggaaaaagcctgtgatggccgggcatgttggctcacagctgtaatcccaacactgggaagccaaggtgggtggatcacctgaggtcaggagttcgaggccgggctggccaacatggtgaaacctcatctctactaaaaatacaaaaaattagatgggcgtggtggcaggtgcctgtaatcccagctacttgggaggctgaggcaggagaatcgcttgaacccaggaagtggaggttgcagtgagcacgatcgtgccattgcactccagcctgagcaacaagagtgaaactctgtctcaaagaaaaaacaacaacaaaactgtgattctccatctaactttttacaattatcctttcacaattcaagaaagtgtgaatgcaagtcattactaacagtatctcagtaaaagtagtccaggagcaaatattttctttttaactgggttcccagctagttccattcccttgaattcagtggcaaagtcactgtcaataaaaggtttttactcttcttcctt

SEQ ID NO: 13202 - DNA, 566 bp, Homo sapiens
ttcggcacgaggggctcggccagcgagtacgactacgtgagcttccagtcggacatcggcccgtaccagagcgggcgcttctacaccaagccacctcagtgcgtggacatccccgcggacctgcggctgtgccacaacgtgggctacaagaagatggtgctgcccaacctgctggagcacgagaccatggcggaggtgaagcagcaggccagcagctgggtgcccctgctcaacaagaactgccacgccggcacccaggtcttcctctgctcgctcttcgcgcccgtctgcctggaccggcccatctacccgtgtcgctggctctgcgaggccgtgcgcgactcgtgcgagccggtcatgcagttcttcggcttctactggcccgagatgcttaagtgtgacaagttccccgagggggacgtctgcatcgccatgacgccgcccaatgccaccgaagcctccaagccccaaggcacaacggtgtgtcctccctgtgacaacgagttgaaatctgaggccatcattgaacatctctgtgccagcgagtttgcactgaggatgaaaat

SEQ ID NO: 13203 - DNA, 487 bp, Homo sapiens
catttgattcttctgccagttttattattgttattatgctcattaatattaatactcagccactgtacctatttaagattgaagaggagaaaggcaaggttttgctgaaatcatgatagcagtgacaatgggtttggggcaggtgggcatgaggggcttgaaggctccttgaagcgaccttcctagttataatatttgaaaatgtagaataatttatgggtcagattgccaatggttccttctcctttctaaaaaccaattctgaatttgcttcaccatatttttgatgatgtgttttatggcctcacaaactcccagctggttccctcgatgatctcgtctctgtggttactgtcaacaatccacattcgtgttgtggcatatcatcttacagaagcatttaaagcagctcagggcttctttcctctgatgtagattttctccattgttactcaacgaggctctgacatcagcctcctttcagttc

SEQ ID NO: 13204 - DNA, 423 bp, Homo sapiens
ttacctgtgtgtgtagatgtgtgtgtttctttcttgctttttgtctgagtgcttttgtttctgtcagatgagccacatattcatatacatatacatgaggatgcatatacacttgtgttagaaatcatgaatttacaccaatgaatatgtttaattccagtccattccacagggtttcttcttctctccttcagtctttatttactcccttttacaacctgtctctgaaaaaatatctttacattaacccagaggtcaatcctataataataacagtttcagaatttctttagaagtacgtgcattttttattgtccttagttatggctagaagattatgaactacaaccattatctttcggcttaccaatataaaaagcaaggggagataaagcatttccccttctgtgtctcaccttttct

SEQ ID NO: 13205 - DNA, 525 bp, Homo sapiens
caacttccttcggtcgtcccgaatccgggttcatccgacaccagccgcctccaccatgccgccgaagttcgaccccaacgagatcaaagtcgtatacctgaggtgcaccggaggtgaggtcggtgccacttggtgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccccgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaaca

SEQ ID NO: 13206 - DNA, 436 bp, Homo sapiens
agcctggccagtggtgtgagctgagtgtctgcatccagacggccagttgcttggtctaggatggggggcaggaggttagtgtggagggagccccagcgtgagaaattgagggagcaactttgtctctgaaactcaagagggtggaggcaagacttctatttttgttgacaggtgccccaagtttcagccctgaaccctgacatatcttccttctcccaagtcctttttcttatttttcttgttttgtattgttttgttttggtttggtttcttttgagatggagtctcactctgtcacccaggctggagtgcagtggcaccgtctcagctcactgcaacctccaccttccaggctcaagcgattctcctgcctcagcctcccaggtagctgggtttacaggcacacgccaccacacccagctaatttttgtatttt

SEQ ID NO: 13207 - DNA, 50 bp, Homo sapiens
gacagaagggtacggctgcgagaagacgacccaagggtacggctgcgaga

SEQ ID NO: 13208 - DNA, 527 bp, Homo sapiens
atctacaaaattctggatactggatctcggtgcaaaacgataataataatacctgctttatataattctaggaaagaagtgtgtacatgaagaatgtgatttctacccataagaaactgaatctaggccatagtgatatattttagaatgtaggtttgttgttcataggtacaggttgtgaacgaaattattataaggactcaggagataattctagtgcagaagaaaaggtcaaatcttcaaaggaagcatattagttcctaagccacagaattctcagtgtgtaccactcttgttcaaagtgtctaaatatttccacaatcataaatttatttgtgggtgtccaccttttgcatctggatattaaatttacacatggcttttatagctggaatgaaatccagatttttttccagtgataccatataaagtcttaaaaaatattgatttccttctttttggggggtggtcagacctggatgaaagcatattgctcctattgctagagaaataatccattatgtgtt

SEQ ID NO: 13209 - DNA, 451 bp, Homo sapiens
gacagaagggagaagtggcaagagggattaaaagatgatgagaagcttgaggtttctgaattagcaactgcgaaacgtcctcaggagagaagctacatgctgcagaggtggcaagaagatggtggtgttatgatcataggctatgagatgtatagaaatcttgctcaaggaaggaatgtgaagagtcggaaacttaaagaaatatttaacaaagctttggttgatccaggccctgattttgttgtttgtgatgaaggccatattctaaaaaatgaagcatctgctgtttctaaagctatgaattctatacgatcaaggaggaggattattttaacaggaacaccacttcaaaataacctaattgagtatcattgtatggttaattttatcaaggaaaatttacttggatccattaaggagttcaggaatagatttataaatccaattcaaa

SEQ ID NO: 13210 - DNA, 655 bp, Homo sapiens
acagaaggggacacagggccgctcagaggccgccgcaatgctcccctctttgcaggagtcgatggatggagatgaaaaggaactagagagcagcgaagagggaggctcagccgaggagcggagactcgagccgccgtccagcagccactactgtctttacagctatcgcggaagcagattggcacagcaacgaggggacagtgaggacggaagcccaagtggcacaaatgcagaaactccctctggtgatgatttcagcctctccttggcagatactaatctaccatccgaagtggagccagagctgcgcagtttcattgctaagcgtctttcaagaggtgcagtctttgaagggctgggtaatgttgcatctgtggagctaaaaattccaggttaccgagttggttgttattactgccttttccaaaatgaaaaactgcttcctgaaacagtaacgatagactctgaacgtaacccttcagaatatgtggtctgttttttaggagggtctgaaaaaggacttgagcttttcaggcttgaattggacaagtacattcaagggctgaaaaaaacatgaattgtgaggcaaggggcctggagagtcacataaaatcctatctgagcagctggtttgaggatgttgtatgcccaatcc

SEQ ID NO: 13211 - DNA, 505 bp, Homo sapiens
gacttggagagtcattcaacagaggccgtgttgggggatgctttggtagatttctccctgaagctctaccacgccttctcagcaatgaagaaggtggagaccaacatggccttttccccattcagcatcgccagcctccttacccaggtcctgctcggggctggggagaacaccaaaacaaacctggagagcatcctctcttaccccaaggacttcacctgtgtccaccaggccctgaagggcttcacgaccaaaggtgtcacctcagtctctcagatcttccacagcccagacctggccataagggacacctttgtgaatgcctctcggaccctgtacagcagcagccccagagtcctaagcaacaacagtgacgccaacttggagctcatcaacacctgggtggccaagaacaccaacaacaagatcagccggctgctagacagtctgccctccgatacccgccttgtcctcctcaatgctatctacctgagtgccaagtgga

SEQ ID NO: 13212 - DNA, 644 bp, Homo sapiens
acagaaggggcgcgggctcgcgcttcggtttccccagacctgctcgcagcaccctgctgtcttcccggtccggcccgctgcccgcggcgccagcaccatgctcttctattcttttttcaagtcccttgtgggcaaggatgtggtcgtggaactaaagaatgacctgagcatctgtggaaccctccattctgtggatcagtatctcaacatcaaactaactgacatcagtgtcacagaccctgagaaataccctcacatgttatcagtgaagaactgcttcattcggggctcagtggtccgatacgtgcagctgccagcagatgaggtcgacacacagttgctacaggatgcggcaaggaaggaagccctgcagcagaaacagtgatggctcctcctcctcttcccctccctctttcattggtgacccataaccccaagtcccagcccagaacccctaacccccaatacttgaaggggttttgtttttttactaatgatggttttgtgggttttttttaagggatgagtggatgagaggagtaatagggaacagctatcctctcttgagaaggggaggataagtaggctgggaaacttcaaagccttcccagtccccagcacctgcctttctcactacttctctg

SEQ ID NO: 13213 - DNA, 599 bp, Homo sapiens
ggcttttggttcttacagtagtcggcgtaggccttaggtgggttcgtgcgccttctacctcgctgtttcggttttcctggctcctcggcccttttctcccctgttgcagctgggagcggacgaagcgcgaagctgggattttttactgtctcctgaagaatttaacacaaacatggatatcagaccaaatcatacaatttatatcaacaatatgaatgacaaaattaaaaaggaagaattgaagagatccctatatgccctgttttctcagtttggtcatgtggtggacattgtggctttaaagaccatgaagatgagggggcaggcctttgtcatatttaaggaactgggctcatccacaaatgccttgagacagctacaaggatttccattttatggtaaaccaatgcgaatacagtatgcaaaaacagattcggatataatatcaaaaatgcgtggaacttttgctgacaaagaaaagaaaaaagaaaagaaaaaagccaaaactgtggaacagactgcaacaaccacaaacaaaaagcctggccagggaactccaaattcagctaatacccaaggaaattcaacaccaaatcctc

SEQ ID NO: 13214 - DNA, 544 bp, Homo sapiens
ggcccgctccggggatgatgtgctggtactgctttgtgggccacccccaatggtgcagctggcctgccatcccaacttggacaaactgggctactcacaaaagatgcgattcacctactgagcatcctccagcttccctggtgctgttcgctgcagttgttccccatcagtactcaagcactataagccttagattcctttcctcagagtttcaggttttttcagttacatctagagctgaaatctggatagtacctgcaggaacaatattcctgtagccatggaagagggccaaggctcagtcactccttggatggcctcctaaatctccccgtggcaacaggtccaggagaggcccatggagcagtctcttccatggagtaagaaggaagggagcatgtacgcttggtccaagattggctagttccttgatagcatcttactctcaccttctttgtgtctgtgatgaaaggaacagtctgtgcaatgggttttacttaaacttcactgttcaacctatgagcaaatctgtatgtgtgagtat

SEQ ID NO: 13215 - DNA, 589 bp, Homo sapiens
  misc_feature 437: n = A,T,C or G
gattatcccatctaacagcagaaggccaagccacactggagagattagaaggaatgctttctcagtctgtgagcagccagtataatatggctggggtcaggacagaagattcaataagagattatgaagatgggatggaggtggataccacaccaacagttgctggacagtttgaggatgcagatgttgatcactgaaaatgatttatgcaagtttaagattctgctcctaagtgtaggagagaacttggtgcctcttccactctggagtgaagttaatgaaagtctttttccttttccaaaacccaacctgaaccagttctttcttgagacagactatactgagacaacaagttgtcaccagcagaagatagataatatgacctttattaacttgatgaattaacttaaccaagagggtatttgtagtttactatntaccctaaaactttctgtgtctgggtaccctctgagtaggcctataattcctaccttgactgtgtgcatcatttgtaagctagcagatctatgtggtgaaaatgcacaggagcttggtagactgcgggggaaagagagagctcctttcgcca

SEQ ID NO: 13216 - DNA, 544 bp, Homo sapiens
gttccagaggcaattcaaggcggaacatttggtttcaattcatctgccaatgtaccaacagaagggttccagttttagaaagatgttgtggaagttaggtacaatgcagcactgagatatatatatatatatgtgtgtgtgtatatatatatatatacatatatataaaaaggtttgatccatcaagcttggctcatgggatctgctgctgcattaaatcgggaaagaaaatgtgaagatttcatttggaatcacagaaaatgcccaaatgaggtcaagatggcgagtgggtgcgagtgagaatagtggcaaaatgtaatgaaaactttacatgagtgcttatttaggttgttcaaagtaaaaagggctacaggtcacagatcgtcagtgcctgagaaagaacattgactcactctatatcaattgaggggaaagtgcagtaccgtcatcttcaagccttgtaagcataaaagagaatacgctgcccatataagtcaaaggaaaatgagcccacgccttgctatgaaacagtgtgtgaatggac

SEQ ID NO: 13217 - DNA, 121 bp, Homo sapiens
gacagaagggggggcgcccagctgccaacaccaagattggcccccgccgcatccacacagtccgtgtgcggagaggtaacaagaaataccgtgccctgaggttggacgtggggaatttctc

SEQ ID NO: 13218 - DNA, 580 bp, Homo sapiens
acagaagggctctctttccttgcctaacgcagccatggctcgtggtcccaagaagcatctgaagcgggtggcagctccaaagcattggatgctggataaattgaccggtgtgtttgctcctcgtccatccaccggtccccacaagttgagagagtgtctccccctcatcattttcctgaggaacagacttaagtatgccctgacaggagatgaagtaaagaagatttgcatgcagcggttcattaaaatcgatggcaaggtccgaactgatataacctaccctgctggattcatggatgtcatcagcattgacaagacgggagagaatttccgtctgatctatgacaccaagggtcgctttgctgtacatcgtattatacctgaggaggccaagtacaagttgtgcaaagtgagaaagatctttgtgggcacaaaaggaatccctcatctggtgactcatgatgcccgcaccatccgctaccccgatcccctcatcaaggtgaatgataccattcagattgatttagagactggcaagattactgatttcatcaagttcgacactggtaacctgtgtatg

SEQ ID NO: 13219 - DNA, 475 bp, Homo sapiens
acagagggggggtaacgagctatttacttcctgcgggtgcacaggctgtggtcgtctatctccctgttgttcttcccatcggcgaagatggccctggagacggtgccgaaggacctgcggcatctgcgggcctgtttgctgtgttcgctggtcaaggtactatagaccagtttgaatatgatggttgtgacaattgtgatgcatatctacaaatgaagggtaaccgagagatggtatatgactgcactagctcttcctttgatggaatcattgcgatgatgagtccagaggacagctgggtctccaagtggcagcgagtcagtaactttaagccaggtgtatatgcggtgtcagtcactggtcgcctgccccaaggaatcgtgcgggagctgaaaagtcgaggagtggcctacaaatccagagacacagctataaagacctagcaagatgcgaggctgccagcatctttgctctc

SEQ ID NO: 13220 - DNA, 588 bp, Homo sapiens
gacagaaggggaagggtctatgaccaaagaagaatttgccaagatgaaacaagaactggaagctgagtatctcgctgtgtttaagaagactgtgtcctcccatgaagtctttcttcagcggctttcttctcaccctgttctcagtaaagatcgcaactttcatgttttcctggaatatgatcaggatctaagtgttaggcggaaaaatactaaagagatgtttggtggcttcttcaaaagtgtggtgaaaagtgctgatgaagtcctttttactggagttaaggaggtagatgacttctttgagcaagagaagaacttccttattaactattacaataggatcaaagattcttgtgtgaaagctgacaaaatgaccagatctcataaaaatgttgccgatgactatatccacaccgcagcctgcttacatagcctggctttagaagagcccacagtcatcaaaaagtacctattgaaggttgctgagctatttgaaaaactaaggaaagtagagggtcgagtttcatcagatgaagatttgaagctaacagagctcctccgatactacatgctcaacattgaagctgc

SEQ ID NO: 13221 - DNA, 583 bp, Homo sapiens
ggcgcggcggctgtacaactcggccgttgtcaccatgccggtcgtccggaagattttccgtcgccgccggggcgactcggagtcagaggaagatgagcaggactcagaggaggttcgattaaaactggaagagaccagagaagtacagaacttgaggaagaggcccaacggggtgagtgctgtggccttgctggtgggagagaaggtacaagaggagaccactctagtggatgatccctttcagatgaagacaggtggtatggtggatatgaagaaactgaaggaaaggggcaaagataagatcagtgaggaggaggacctgcacctggggacatcgttttctgcagaaaccaaccgaagggatgaggatgcagacatgatgaagtacattgagacagagctaaagaagaggaaagggatcgtggaacatgaggaacagaaagttaagccaaagaatgcagaggactgtctttatgaacttccagaaaacatccgtgtttcctcagcaaagaagaccgaggagatgctttccaaccagatgctgagtggcattcctgaggtggacctgggcatcgatgctaaa

SEQ ID NO: 13222 - DNA, 406 bp, Homo sapiens
gaccggaaaactctgaggacatgaatagtcgccaggcttggcggctctttctctcccaaggcagaagagatcgttgggtttcaaggccccgcgggcatttctcgccggccctgcggagagagttcttcactaccacaaccaaggagggatatgataggcggccagtggatataactcctttagaacaaaggaaattaacttttgatacccatgcattggttcaggacttggaaactcatggatttgacaaaacacaagcagaaacaattgtatcagcgttaactgctttatcaaatgtcagcctggatactatctataaagagatggtcactcaagctcaacaggaaataacagtacaacagctaatggctcatttggatgctatcaggaaagacatggtcatcct

SEQ ID NO: 13223 - DNA, 610 bp, Homo sapiens
aactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgaaagggcgaattcgtttaaacctgcaggactagtccct

SEQ ID NO: 13224 - DNA, 123 bp, Homo sapiens
gtgttgttctagagcctttattttctacagggcgtttgggctggggaagggtcctgtacatttgcaacaggaggtgtagaatgaaccctgcattgaatgtgtaagcatccaaagctgtcactg

SEQ ID NO: 13225 - DNA, 476 bp, Homo sapiens
ggcatttttcctctttgaccactaaccatgtgaaattctcatattgacctttataatgatcatgaactcttagtatcattgggaaggccacatttgccacttatgattgtaaaccttatcctccatttttcctgttattgttggtgcaaaaagcacctattataccaggactttaaaaatcagtctgataagtctttgataagtctaataataataactgataagtccattgaatttgcttctgattactttttctttagtagctaaacatgtatgtactcctatgattacaatgaacactcctctccatttaaattaattatttacattgatgaaatagcaaaatgttaatgactaaatactgtcttggttttttcgttccaggtcagtcaatattaacttcttataattttcttttttttctttatgtgtgtgtgtgtgtgtattttttttttttaatttcaatggcttttggg

SEQ ID NO: 13226 - DNA, 163 bp, Homo sapiens; identical to SEQ ID NO: 2452

SEQ ID NO: 13227 - DNA, 520 bp, Homo sapiens
acagaagggctctcacctgtcattcttctgagggtctcagtacaagggccctgggatggagccaacctgggtattcacaacaggcctgacttgatactaagtgattagttttccaagttgtcccactgccattcaaagtcagcccttgagtgtatttgttctcagtcctaaccctggggccagagattggtccgaggttgagaattccttcctcctcatccttggtgttgctttctccaaatgattgttttagactagccaaaaatgccgtggcaaagagctcagaaatccaatttggataccaaaggtttctcatgttaatttctcagcccccaaagaagcatcttactcctgaaccttagacaggaagtattgtttcagtcacagaaagcttttctgggtacctctggttagcactttctactctctgatatttcctatgtacatagcttttattgttgtaaatcctttcttaatggttaaataggattgttagcaactatgggtttgcagttttctg

SEQ ID NO: 13228 - DNA, 581 bp, Homo sapiens
atccacataagctaggctttccgcttttgccacggacagtgtgaccaagatatttccagagtaaataacccaccacaaccttggtaattcctcttttcttcttaagctccaggaagcgaaagcagaaggactcttttcagactgccctctgtagcctacattgcagctttccaaaacaggcagctagcactgggaaagcccatgtggtgaccccatatttttctgaggttcttcttttccatggtgttactttattatcagaaagtaaattcagaaaacaggtcttgcccttagcagacaagaaccacaccagtttcttgtaaaggtgacgtatacattgggattcaggagtgacacagaggtccagccccagaacttgtaaggattttgtttgaacactgagcagatgcctcctccctgccacccatcacactagttagggctggccatgaattctatgccagagtcactcctgcagtctgctagggatgggccttcttatcccactctcgcacacatcccagtctagtctttgccttcacagagtcctccttgacacccctgacttaatgatagttgct

SEQ ID NO: 13229 - DNA, 87 bp, Homo sapiens
tataacatctgaagcaagtgaaaggtgccatcaagagaaacggaaaacaatcaatggagaagatattctctttgctatgtctacttt

SEQ ID NO: 13230 - DNA, 527 bp, Homo sapiens
agatgactggtggagtatacaggtgtgaatatagaggaaagtaaactgagaaagtaggaataagtatgatcttggatgtggaaactcagagtaagaattaaattctggctgtactgatctcaggaatgtagagacctcagaatatggagaatgtctgtctcatttaggggaataaacaaatactaatgaaatttgaaattggtagagaaaatgttatatttcaaattttaatttataaactttaattcttcttttagatctactggtatcgacaaggagacttagaaccgaaatttagaaagctaatttactatatcatattttctatcatcatgttgtgtatatgtgcaaacctgtacttccatgatgtgggaaggtgaggctgccaaggagaagtacttaccaggactcttcaaaatgatacattaggacagtgagtaatttttggataaggtatgctgaagaatctcctgcagaagtctgatacatgattttcatgttaattgtaaatgttaattccctcttgc

SEQ ID NO: 13231 - DNA, 644 bp, Homo sapiens
ggttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaatctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatt

SEQ ID NO: 13232 - DNA, 258 bp, Homo sapiens
gtaacaaactacagaaagtgaaattgcagataaaggggattactgctcctctgctctaaaattggtgtttgggtgatcagaagcaggtagccaatgggaagagcacttctgagtgataactaaagcagtttggtggccttttcacattctccaatgttcaaacatattttccactttccattttctctttcacctcattttgcctctctatcccccatccctgcttatttcttaagcccattgatggcactcattaaa

SEQ ID NO: 13233 - DNA, 361 bp, Homo sapiens
ggttttttttttgagggggagtcttgctctgtcacccaggctggagtgctggggggcaatctcggttcactgcaacctttgtttcccgggttcaaccttttctcctgtctcaccctccccattacctgggattacaggcacccaccaccatgcccagctaattgttgtatgttaagtaaaaacagggtttcaccatgttggccaggctgggctcaaactcctggacctcaagtgatctacccgccttggcctcccaaagtgctggctttacaggtgtgacccaccgtgcccggccaccaaaatcctttggtatacccaacccttttggttaccgcctcatgaaaaatatgcttcccgcatt

SEQ ID NO: 13234 - DNA, 459 bp, Homo sapiens
ggaccattaaatgaaataaccaaaaggctgaagatgatagaaaaatagaaatgaaggtacatatgcacacaaaatttgcctcatttgtttgctgacatttatttttcatcattgcaaccattgccatgaagaacatgaccatggccctgaagcgcttcacagacagcatcgtggaatgacagaattggagccaagcaaattttcaaagcaagctgctgaaaatgaaaaaaaatactatattgaaaaactttttgagcgttatggtgaaaatggaagattatccttttttggtttggagaaacttttaacaaacttgggccttggagagagaaaagtagttgagattaatcatgaggatcttggccacgatcatgtttctcatttaaatattttggcagttcaagaaggaaagcattttcactcacataaccaccagcattcccataatcatttaaattc

SEQ ID NO: 13235 - DNA, 566 bp, Homo sapiens
gaagaaggggagcaagtgagcagatcctccgaggcaccagggactccagcccatgccatggcggattctgagcgcctctcggctcctggctgctgggccgcctgcaccaacttctcgcgcactcgaaagggaatcctcctgtttgctgagattatattatgcctggtgatcctgatctgcttcagtgcctccacaccaggctactcctccctgtcggtgattgagatgatccttgctgctattttctttgttgtctacatgtgtgacctgcacaccaagataccattcatcaactggccctggagtgatttcttccgaaccctcatagcggcaatcctctacctgatcacctccattgttgtccttgttgagagaggaaaccactccaaaatcgtcgcaggggtactgggcctaatcgctacgtgcctctttggctatgatgcctatgtcaccttccccgttcggcagccaagacatacagcagcccccactgaccccgcagatggcccggtgtaggcgaacttccctcatttctctctgcaatctgcaaataactcctccattga

SEQ ID NO: 13236 - DNA, 554 bp, Homo sapiens
agtcattttcatgatcacaaaatttgtccaggatagacatagagctagaagaaacagacttcgtaaagatcaacttaagaaacttcctgtacataaattcaagaaaggagatgagtatgatgtatgtgccatttgtttggatgagtatgaagatggagacaaactcagaatccttccctgttcccatgcttatcattgcaagtgtgtagacccttggctaactaaaaccaaaaaaacctgtccagtgtgcaagcaaaaagttgttccttctcaaggcgattcagactctgacacagacagtagtcaagaagaaaatgaagtgacagaacatacccctttactgagacctttagcttctgtcagtgcccagtcatttggggctttatcggaatcccgctcacatcagaacatgacagaatcttcagactatgaggaagacgacaatgaagatactgacagtagtgatgcagaaaatgaaattaatgaacatgatgtcgtggtccagttgcagcctaatggtgaacgggattacaacatagcaaatactgtttgac

SEQ ID NO: 13237 - DNA, 617 bp, Homo sapiens; identical to SEQ ID NO: 2481

SEQ ID NO: 13238 - DNA, 562 bp, Homo sapiens
caaagtggtcgactagtaatttaataacctgctagaagaaaaatgcattgcattagagaaagataaccaaacccagagtttgtataaatatcatgcacaatgttcaactgtaattcaaaaattaccagtgatggatacagaaaaatgtgacatgtaatttttttttaaagtccatggaaatagattcctcgatgattcagaagttgtagacaaggactttaaagcagaaattataaatatattcaggattttaaaaaaatatgttttcaggcccggtgcggtagttcacgcctataatccaccagatgtggtggcgtatgcttataatcccagctactcagaaggctgaggcatgagaatagatagcttgaacccaggaggtggaggttgcagtgagccgagattgctccactgcactctagcctgggcaacagagtgagaccctgtctctaaaaatatatgtatatatatagtcataatgagggaacagatgagaaaataagcagagaaatgaaaattttcaaaaataagtaaaaagttaaggtataatacctgaaatttt

SEQ ID NO: 13239 - DNA, 508 bp, Homo sapiens
tgatagtttgatctagaaaccagcagctactggttcaaattcaggttctggcgtcaaatagcgacatttccagtttctcttaaaaaccgtgtttggtttcagttgggataggcttgttttgtctgttgaaaatgttgctaggtttttttctttcatttttctctcattccatttctgccttaactttagtttgttcacagggaggcaaagctgacatgaaccttttgtcgtgggacttcaggccacattggcttgaaggcattcgtttccttctggggtgggaacaggccctcatggcaggcttgttcccgtggctctgagcgaggcctcttcctgctgggctcccagactcctgcatccaggcccccaccttctcggcttctggtttttctttctttttggtagaacacaacatctaccattcagttaaaccttctttatctcctcctttggcatccatttttccaaagaagagtcgagtcctctgaggtctgtgcttgaaagccgt

SEQ ID NO: 13240 - DNA, 612 bp, Homo sapiens
gacagaaggatgaccagaacatcacacctttgcacacggacttctctgggagcagcactgaaagaatttgaaactgacttttggagctttccttcttttttcatttcaactgaaaatgctttaggtaaaaacctttccagtatgttcacctctagaatagccacccaaagaccttcctgaggctgcctcagaagcaccacttgctgttttgaatgactctactagtatgagaaggatgtgaaggtggttggctggttgggctttaacttcctgggattcataatttttaagcttggaagatagctgctgttcccatgatgggcacatttcctgagaagcttgaatgactgatgagcatagagcacccctgccttcctcaggaaacctgaccggcaggggctctctggcttcctgaaagcttcacctcttccctcgtttatatctcaactgtaagggcattttcaagcttctgttcatggaatgagcaactcagactgtctggagcttgctgagtacaaacacaccaccactaagtttcagaactttccttagaacttgggcaaaatgtggtggtaactcttaagtgcttttggtatctcttgagattctaac

SEQ ID NO: 13241 - DNA, 359 bp, Homo sapiens
tgtttgcgtctggggtgtgttatcaaacagagcatggtctacatcccactgtgtcaaccagaagagccaagtgttatctcaattggcccagtgtttctccaggctggggactgttaagggctctaagggaatgtagacagagtctccctgttattctgacttcctgcttgatgagctttcagttcctgtttttgctattgtttcctaaatttgacctacatattacatgggtgtagtgtgttgaggcttttcaaagaagggtctagtgagctaagttccatcttctggtactcattgatcaaactgacctttctattctcataagcgtttctacccaaagttgtgtgtggaaggagtgt

SEQ ID NO: 13242 - DNA, 545 bp, Homo sapiens
acacttgccaagcacatcatgtctgaacctgaagaaatcactactatgtctggacagaagttaccactgaaaatgtctgttgattacatttctttctcagctcacacggattaccagcaaaccagtgaatttattcgtgctttgaaaccgcctcatgtgattttagtccatggagaacagaatgaaatggccagattgaaagcagcactgattcgagaatatgaagataacgatgaagttcacatagaggttcataatcctcggaatacagaagcagtgaccttaaacttcagaggagaaaaactagccaaggttatgggatttttagcagacaaaaaaccagaacaaggccagcgggtctcaggaatacttgttaaaagaaactttaattatcacatactttctccttgcgacctgtccaattatactgacctggccatgagcacggtgaagcagacccaagccattccatatactggtccctttaatttgctctgttaccagctgcagaaattgacaggtgatgtggaagaattagaaattca

SEQ ID NO: 13243 - DNA, 558 bp, Homo sapiens
acagaagggagaggcgttggcggcgtgaggctcaggactgtacatcagaggaagccaaaagccagctggaatacttcctgaatacagttttaatcttgtttgcaattatttcgaaggggagaaatcatctggatcagaattaagatgctctggtttcaaggaaatagcatgcaacttgccagatcctcctttggactcttcttgagaaattgctctgcctctaagacaactctgcctgtgttgaccttattcacaaaggtacaaagtgaaaaagtaaaattgttgggtgaagaaagttgtacatttaagaaaaagggacaaagttgaaaggaaaggcaatggaataagctttcttcagacctgctcttcaatttttctatcagcacaacagcagcaactcagttttctacccagataccttattatctcccaattagcaaagagtaaattgatgtatttaatggtcatctggcccctacattgaaaaaaatgaagtataggttataatatggtgtttaaaaatgtatcatttagaaatacaatcaattatttttattt

SEQ ID NO: 13244 - DNA, 532 bp, Homo sapiens
caggcaaagcctacaacgctgagacaatcccctaacaacatggtagtaactaaggaaacttttatactaggcttcttagttttaaaaggaagtggcatcattgtttcagttctagtttgtatttttctctcagatatttttcttctttaaaaatctttcccagaagttggttcctagaaaactcaataccatcatctcttatctctatacagggactaggtaataaaaccttcaaaggttgtcaaaggtcatcaagcagtgttcatttatcctgtcacatgtttctgtttctatagtaatttagaaattgcaaatagttaacttttcatcatgtaaaaagttaacattatcctatttccatagataccatggacggcggtgtggcctgagttgtcagtctttaatcctgagtcatgtggctctcttttcatctttgatgtcagttccaattatttggcatcaaaaaccttcatggtaggtagagttttaggtaaaagtggatctagggttactttctttattaacatttcct

SEQ ID NO: 13245 - DNA, 55 bp, Homo sapiens
ggtccttccatctctggggcccactctcttctgtcttcccatgggaagtgccact

SEQ ID NO: 13246 - DNA, 407 bp, Homo sapiens
ctgtgtggctgaaaagtgaaggcaagagctgatttggcctctgtgctcccctccgcaaggggatcgttttctccagaagagctggatattctttcgcccagttatggcagacaagttaacgagaattgctattgtcaaccatgacaaatgtaaacctaagaaatgtcgacaggaatgcaaaaagagttgtcctgtagttcgaatgggaaaattatgcatagaggttacaccccagagcaaaatagcatggatttccgaaactctttgtattggttgtggtatctgtattaagaaatgcccctttggcgccttatcaattgtcaatctaccaagcaacttggaaaaagaaaccacacatcgatattgtgccaatgccttcaaacttcacaggttgcctatccctcgtc

SEQ ID NO: 13247 - DNA, 577 bp, Homo sapiens
gacagaggggagagctgcaggccacagtcccgggcctctggaagctgtcactgcctctgaaatccttgcagaaggctttcagccttacaaggcctgtgggtgagaccttgccccagaccatgggctccttcagcctcactcttcctggtatctctgggctgggcacagaggaacatcagggtgaacgaatgaatgaacagacaatgcacacatcactgggtgatcttggagaaggtgcctctgctccctcacatgatctgtgacacccagatttggcaaggcccatagcagtgagtgttgtataagttttgccatcctggtcctgaagcagggcccagcttggtgctgtgagaaacagcccacctttttgttacctcctgtgtctctatgaaggaggactggaagaaaccctactgacagggcctatcatcttaaaggaatattttgggctgggcgcggtggctcatgcctataatcccagcactttgggaagccgaggcaggcggatcatctgaggtcagtagttcaagaccagcctggccaacatggtgacaacccgtctctacttaaaaaatac

SEQ ID NO: 13248 - DNA, 157 bp, Homo sapiens
atcatatgttgactgcagttatgaatattcatgtacatgtctcctggaacacttgagcaagacttactcctggatatttgcccaaaaatggaactgctgggttttaaggtatgtaaatgttcaatttgacaagataatgataatttttggctgggcg

SEQ ID NO: 13249 - DNA, 567 bp, Homo sapiens
aatatatcgtatcagttagggtggggcgggaacaaatcacaatggtagaatgtcatcaggtaagactattttcgcttcttttttggatcttcagttgcttcaggccatcttcatgtatatgtgcaggcccacaggggatatgatggcttagcttgggctcggaggcccgacactgggatgtgtaaccattattctagatggctatgctaaacccagcataatcagaggttccattttgttgagaaagaaagggacaacgaatattgggcaacaatttgtcatctctgccactgaaaccactgcttctctgtccactacattttatcaaaggcagagtgtcttgcaatcagcttgacttgcaagaggctcaaaggcctcttggaatgccttgcatcagcttgcttttgtggcataaaaagttaccccaggtgggcgcagtggctcacccctgcctgtaatcccagcactttgggaggctgaggcgggtggatcacttgaggccaggagttcaagaccagcctggtcagcatagtgaaaccccatctctactgaaaacacacaaaaagt

SEQ ID NO: 13250 - DNA, 205 bp, Homo sapiens
ggttccagagcacactgatgccagttgcagcagatattaacacacctttcataaaaaggcccttggcacactgttgggttctggtagagacagaaggcctggccatgggacactaaatgaccaggcaaccgtaattccacatcatgagctggactctgtcagagctaccaagttctaaaggtgaacaagcccaacaattcatcac

SEQ ID NO: 13251 - DNA, 580 bp, Homo sapiens
gggttcaatatcaaagaaattatctcacccagactgatctggatattggcactattaagtgccccaactgttaacctcaaagaccattaaagttgctcctaacttgtttccaagatccaaactccttaaagtagggcatgaagtgaaagtgtgacctaaactgtctatgataatttgggtgttacctaagttagcaaattataaaattgggcttgtgcatcagcatttcactgaaacctggagagaaagtgtatgaagacaaagaaagactgaaagaaactagcacacaaacagaaagcttagacatccagaggaattgttcccactgctttccttcccctccttcacaccatgctctgcctacatggggagttttccatgaccacttgatggtgaaggagaaaacatccagtacaccgtatgtcaacagtacatggaagtggagaacttctgtctcatagccccattcaggcaagacctaaagattatagtaaagggactaggtgcagtggctcatgcctgtaatcccagcatttggggaggccaaggtggaccaatctcttgaggtcaggagttcgag

SEQ ID NO: 13252 - DNA, 645 bp, Homo sapiens
atggaaacttgccacatattaagacacaaaggaaacttcagtaattccacaaagcagagagaatctaaacatattctctaatcacagtacagtaaaactagaaattaaagactcaaaaattccctactggaaatgttactaactctattaaattactcttgggtcagaggacaaatacaaaccacaaccatataatttgttcaaaatggtaacaccttgtatcagaatccatgatgcaattaaagcaatgaggcaaagaaaattacatccaaaatgaaaaagaaacatcaaatgcaaaattaggaaaagattaaagtaaacaaaggagaaacagttgcaaaataacaagcaaggctgggtgtggcagctaatgcctgtaatctcaccactttgagaggctgaggcaggcacactgctttgagaccaggagtccgagaccagcttggccaacatggtgaaaccccatctctgctaaaactacaaaaattagccgggcatggtggctcacacctgtgatcccagctacttgggaagctgaggcaggagaatcgattgaacctgggaggtggaggttgcagtgagctgagatagcaccactgcacttcagcctgggagacagagtgagactcctccaaaaaaaaaaaa

SEQ ID NO: 13253 - DNA, 447 bp, Homo sapiens
acttatacttgatttgtaaataccatatttttttaaatcagaagatcatacttcccccactcctttttctcgccgtctttttcctctggatgtattttgctggaaacatacactgtattctaaaccctttctactcctagtgtccaaagtatggctgggcatgggcggctttggtatctatcaggggtttattagaaatgcagaccctcaagctccacccttcgtctgctgaaccagactttgcattttaacaagaatcccaggggattccttttgcaccttaggtgtgaggagcactgatctaatgcaatttaattgtcaggtttgaatcatcatttgttacataacccagtggcagagagaagaataaatactgaaaacaggccgggcatggtggctcacgccctgtatcccagcactttgggaggccgaggcgggcggatcacg

SEQ ID NO: 13254 - DNA, 360 bp, Homo sapiens
attgatcacccactaatagggaacgagagccgaacagttgaagagagttcactgactccccagccccaggtgggccttgtgcacatcatgaccagttttgaagatgctgacacagaagagacagtaacttgtctccagatgacggtttaccatcctggccagttgcagtgtggaatatttcagtcaataagttttaacagagagaaactcccttccagcgaagtggtgaaatttggccgaaattccaacatctgtcattatacttttcaggacaaacaggtttcccgagttcagttttctctgcagctgtttaaaaaattcaacagctcagttctctcctttgaaataaaaaatatgagt

SEQ ID NO: 13255 - DNA, 380 bp, Homo sapiens
ggcacgaggtgaaccttccccagtcctatcagagcagactttctggggttgcataccttcagaaaccgatttggggcccaatctgaatgcacatataagtgcgcatagcgctaaaattccaggcaacactttgtattgagagatgccaaaattttggtcaggccctgtgacatctaaagtcaccaatgtaactacaccatacagattaaaccctcacatgatcatgtaagctatgcagttacccaagctgcatcatttagaaaacctgtacagctgttatggaaaccatccctagtcaaggacactttaaatatgtagtctaaataccgttaaagtaggcccactagctgtgttcacattttcccttggccaccttacca

SEQ ID NO: 13256 - DNA, 498 bp, Homo sapiens
ttgttgttaccgtgtgccaatgtgtcccatgtgggttgtgccaggtagagaaacaggaagtcaatcatctgtgacagtctctattctgtcgttttgctccttggtatttgatttgcactatatttagttgaagcctgttcactgtttaaaaccggaggtatcttcaaaggcatggagacctggttccagtaaatgtcccaccagtggggtatagaaagcatgctcatgaccctgccgtgtcgtctgaggtacccgttcttatcctagtggttcaggaagagaaaacgcagtttgcactttcaagacagcttctctaaggctggcatgttatctccttgctttgctttttgccgttttaaaatgtgtaattgttccagcattccaatggtcttgtgcatagcaggggactgtaaccaaaaataaacatgtatttgtgtaattggtttgaagaagtcttgaatagctctttactgtcttacttggggttgataagatttg

SEQ ID NO: 13257 - DNA, 667 bp, Homo sapiens
gaattcggcacgaggtgggctctcccttaaagacacatggccacagacacctccttcgcatatgtaatatgccttcccctgcggccttccgtggtcacagcaacagggactgctcaccccctccagctggggcttttctaacaagcacagtcagaaatgcgcaggcctggggttggggatgaacagaagttgattagtgggcacagaaatacagttagatagaaggaatagttccagcattcgatattacagtagggagactgcatttaacaataattgattgtatatttgaaaacagctagaagaataagaatattcccaacacaaagaaaagataagcgaggtgaaggaaatcccagttaccctcattcagtccattacacattcgatacaggtatcaaaatatcataggcacctcaaagacatgtacaactcttaatttaacatttttgaaagaaaaaaaaaccggccagagcattaaaacaaataaaataagaaacacagaggccagtgttaggtgaagaactccgctgcttcagaaagagaatagcagcgctcgcttaccgtgggaacacggccagttaacaaaatgggttttggttttttgttttgttttgttttaccattggtaataagatagttaacataagtggtcagaacttcgctg

SEQ ID NO: 13258 - DNA, 502 bp, Homo sapiens
agcccaggagttcaagtccaacttgggcaacatgacaagacccttgtctctttaaaaaagcaactcaaaccatgtcttgaaaagctatttaatggtcagacacgatggctcacgcctgtaatcccagcactttgggaggccgaggcaggcggatcacttgaggtcaggagttcaagaccagcctggccaacatggcaaaacccagtctctactgaatgaaaatacaaaaattagctggcctagcagttggtggtggcaggtgcctgtagtcccagctacttgggaggctgaggcaggagaatcgcttgaatttgggaggcggaggttacagtgaacccacatggcgccactgcactccagcttgggtgatagagtgagactctatctcaaaaaaaaaaaaaaaaaaactcgagcctctagaactatagtgagtcgtattacgtagatccagacatgataagatacattgatgagtttggacaaaccacaactagaatgcagt

SEQ ID NO: 13259 - DNA, 495 bp, Homo sapiens
aaacatgagacatagaatcattgagattcatcaagaaatgtttaattataatgagcatgaagttagtaaaaggtggacatttgaagaaggtattaaaagaccttactttcatgtgaaacctttggaaaaggcacaactaaaaaactggaaagaatacttagaatttgaaattgaaaatgggactcatgaacgagttgtggttctctttgaaagatgtgtcatatcatgtgccctctatgaggagttttggattaagtatgccaagtacatggaaaaccatagcattgaaggagtgaggcatgtcttcagcagagcttgtactatacatctcccaaagaaacccatggtgcatatgctttgggcagcttttgaggaacagcagggtaatattaatgaagccaggaatatcttgaaaacatttgaagaatgtgttctaggattggcaatggttcgtttacgaagagtaagtttagaacgacggcatggaaatctgga

SEQ ID NO: 13260 - DNA, 397 bp, Homo sapiens
gaaatccaaagctgaccaaaacatggtccccaccttttggagcttacagtctgttctggggaacagagattcagccagagtcaagaaacactggatgccagctagattatctgttctgtgctttggtgtctataagtacatatgtggatatgggttcattttatccctaaacttagtaccaaaccagcatttaatatctaattataaatctaatttggcctaaactttattattgcacactgcctgaacaaaacctatttgtctctatgtaaattttttcctcatggaacaagggtgtgaaatgaaaatattttaggatttattcaaaaacagactattctgttttcagcttcagaattgatctttgaatcctaaggaacctctgtcaacagttgag

SEQ ID NO: 13261 - DNA, 662 bp, Homo sapiens
  misc_feature 662: n = A,T,C or G
acaaggtggacgcccaggaggagaactttctgcccaagtaccagcgtgtgaaggacctgtgtcagcgtgctgagtaccagacggcgtgtgagcagctgggacagaagtggcagtgtgtggaggacgccacggggaagctgaagctgcataagtgcaagggccccatgcggctgggcggcagcagagccctctccaacctcgtgcccaagtactacgggcagggcagcgaggcctgcacctgtgacagcggggactacaagctcagcctggccggacgccggaaaaaactcttcaagaagaagtacaaggccagctatgtccgcagtcgctccatccgctcagtggccatcgaggtggacggcagggtgtaccacgtatgcctgggtgatgccgcccagccccgaaacctcaccaagcggcactggccaggggcccctgaagaccaaaaagacaaagatggtggtgacttcagtggcactggaggccttcccgactactaggcggcaccccattaagtgaacattaggcttcttctaaagacaaacagtccatgggactggacttgtcaagtcctgaggcctgaagacacaacttccaatgacccgaattggaacctgcgaacaaatataaactgagggagccgaggtccctgagaaaacggn

SEQ ID NO: 13262 - DNA, 204 bp, Homo sapiens
gaggtgaaggctgcagtgagtcaagattgcaccactgtactccaccctaggcgacagagcaagaacctgtcttcaaaaaaaaaggaattcttagaaatatacaccagatattaccatacatatgaaactcatatatagagggttataaacttttgcagatcatttacctgcaacattgttgattttactccatgaattctctat

SEQ ID NO: 13263 - DNA, 152 bp, Homo sapiens
cagatatccctctctccatgaacaaggtgagtgagctctttttctgagtacatttggtttttcaaaatccctccaaggaatcatttccttgaccaaatgccctcatctgtggtggcgatcaacatctttgattttacccttttttttttttt

SEQ ID NO: 13264 - DNA, 483 bp, Homo sapiens
ggatttcaccatgttggccaggctggtctccaactcctggcctccaatgatcctcctgcctcagcctcccaaagtgctgggattataggcatgagccaccgtgcccagctgctaactagaaatgtaaagtgcacagagtggtagtgctggtaataattctagagtataaaaacaatttaaaattttttggagaatttgtttttcagatttgaaaagaaaaggtgaatgatacacatatctgtttaaaacaatgatacaggaaaggttttctttaaaacaggctaaaaatttttgccttcctttcctaatttctaaagatgatggaatagaaagaccattatctgggccaggtgcggtgggtcacgcctgtaaccccagcactttgggaggccgaggtgggcagatcacttgaggtcaggagtttgagaccagcctggctaacatggtgaaatccccatctctactaaaaatataaaaatcagc

SEQ ID NO: 13265 - DNA, 590 bp, Homo sapiens
aagaaggtgattgtgaagaaaagactggaaagcaaagaggaagtggtttccatacatttacttatttatttctttcaatatacttttgatatactcgttatttttctaactcattaattttctgaaatttagaaggtgaggttagagaggttaagtgactgtttaaagctccatggctgaaaaactgccaaaccatgatggtcttaagtcagaccgtcttcagtatcctggcctcttaccttgttgcttcactacgtgtcaagaagtaggatctattagatgtagtatctcaccataagaaaggtagatacaaagactagaaggaaagaagtaaccttaatctgcacttgcatgtggaaaatgcatatttttaagaggtaagaggtggaaagaaagtagaacaggatttgatggaaaggtaggaggaagtgaaagactggatggagctgagagaagttcacagagatgggacagttaaggagtatgagaaaataatgcatatgttgattgttaaaaactcattactcttcttgaaaagattaccttctaagccaggtggaggaaaaaattagattgaaaagatctgatag

SEQ ID NO: 13266 - DNA, 360 bp, Homo sapiens
atagatgagatttaatctctttagatgggaacaatccaataaagtcctacaataatatagggcaataaattttggagagctttaattactgtgcaagaaaaatattctagttgaaatgaagagtctccttggcctgtttccgcacagcagagcaaaccgtcttctccattcacatttcttggagttaagagcctggcctaggctgggcgtggtggctcacacctgtaattccaacactttggggggccaaagggggtggatcacctgaggtcaggagtttgagatcagcctgggcaacacagtgaaaccctgtctctacaaaaaatacaaatattagccacgtgtggtgacacacgcctg

SEQ ID NO: 13267 - DNA, 539 bp, Homo sapiens
ggcacgaggctactcaggagactgggcaggaggattgcttgagcccaggaggttggggcttcagtgagccatattcacaccactgcgttccagcctgggtgacagagcaaggtgctatctccaaaataaataaataaatgttaaatttgcttttttctctctctctttttttatgtagaatttgtttgttgatacttactgaatgtagtgaccctgctgtggtaatgaacacttctagtgccttctaggcttaaaataccagacagccccaaataacaaatgctcttttgtgttttgataggttggatttctgtttgcttaatattgggaatactggggggaaaaaagatggtgttttcattctaaggattgtcctaaagaaagtgctactttatttttaagaaagtaaggccacttgttatataagaaataacaagttcccattgggtcccattttgcaaaaggggataaagaattagactgatagcatcatacgaggcatatttcactatacaaagtgttgtacacctgtctataca

SEQ ID NO: 13268 - DNA, 501 bp, Homo sapiens
cgaattcggcacgagctcagctctcaccagctgtcagatgctgccacagggcgagaacctccaagatgtgctccccagggacatctactgccgcctcaagcgccacctggagtatgtcaagctcatgatgcccttgtggatgaccccagaccagcgcggcaaggggctctacgcagactacctcttcaatgctattgccggaaactgggagcgcaagaggcctgtctgggtgatgctcatggtcaactccctgactgaagtggacattaagtcccgtggagtgcctgtcttagacctgttccttgcccaggaggctgagcggctgaggaaacagactggggcagtggaaaaggtggaagagcagtgccatccattgaatgggttgaacttttcacaggtcatctttgctttgaaccagaccctcctgcagcaggaaagcctgcgagcaggcagtcttcagatcccctacacgacggaggatctcatcaaacactataactg

SEQ ID NO: 13269 - DNA, 578 bp, Homo sapiens
ccacctactgcgtcttggtcatggagaagaagagctggagacagagaaagatttcagcagaatcctcaggatggatttagccgactaaaacgatggattatgattggcgatcatcaccagttacctccagttattaagaacatggcctttcaaaagtactcaaacatggagcagtctctcttcactcgctttgttcgcgttggagttccgactgttgaccttgatgctcaagggagagccagagcaagcttgtgcaacctctacaactggcgatacaagaatctaggaaacttaccccatgtgcagctcttgccagagtttagtacagcaaatgctggcttactgtatgacttccagctcattaatgttgaagattttcaaggagtgggagaatctgaacctaatccttacttctatcagaatcttggagaggcagaatatgtagtagcactttttatgtacatgtgtttacttggttaccctgctgacaaaatcagtattctaacaacatataatggccaaaagcatcttattcgcgacatcatcaatagacgatgtggaaacaatccattgattgg

SEQ ID NO: 13270 - DNA, 367 bp, Homo sapiens
aaaggaataatgtgtccaaagattattatggaattgtctctctgcatacctatatcagctgtttgtcacagctgtgttcttatgtgactgattcttcctgaagattagaaactcctcaaagactggttattagagcttattcttcattatagccccagcacttagtgcaatgacagaagcaaaaatattaattgaattgagagaaaattgagatatagagacgagtcatttttgttcacaacagaactagtatttaatgaaatataatggaaaagactgagttgggttactgtttaactgagagcatcagagatggataggcagggaggatttagaactgagagtgaattacagcaatgagggaagc

SEQ ID NO: 13271 - DNA, 616 bp, Homo sapiens
catgtattaaaacttagatatcgcctcaccgtgaatgcatcagacactgtactgttctcaccactagggtgggccctctgcagccacaaatagaggagacagttggggataaaatcataactgatgaatagagagactgagtgcactagcaaacctgtagaaattctaggctcacaggaatagcaaaagacagcccactaaataaagagactgtcaagaagcatttcacacctaacatgagcaataaatggattcccatccaccaacaacgtttttcatgattttcctcatccacaggttcaatgagaagctttgtaaatttattttgtttaactgcagacaataatcactctcagggctgggcatggtggctcatgcctgtaataccagcactttgggaggctgaggcgggcggatcacctgaggtcaggagttcaagaccagcctggccaacatggtgaaaccctgtctctactaaaaatacaaaaatcagctgggcgtggtggtgggcgcctgtagtcccagctactcggaaggctgaggaaggagaatggcttgaacatgggaggcagaggttgcagtgagctgaaaatgcgccacatcactccagcctggg

SEQ ID NO: 13272 - DNA, 59 bp, Homo sapiens
ggaaacaaatccacacttagacacaacaatggtaaaacaggagcacctaacagattggg

SEQ ID NO: 13273 - DNA, 635 bp, Homo sapiens
tccaagaggtaactaaagtatccaggctgatggaagctccatcatcttgtggctatctcatctagtacccgaggcctttatggatgtcatagcagagtaagagagtgcaggagggttgagcaccagttctctggctcattggtcagagctagtgacatggcctcctcttcctctaagaggattgggaaatccagcaaacagtaattgactctaccacatcttttaagaatagtgttttctgctacatttaaccagagttactgccattgctttcattcaagaactctgactagtaaaggatatgggggtgagaatatttaaagatatatatcttcaatttttttctgcttacaaaagtgatacatacatgttataaaaatttgaacgtgactgggtgcagtggctcatgcctgtaatcccagcactttgggaggccggggcgggtgaaacacgaggtcaggagttcgagaccagcctggcctacatagcaaaaccccgtatctactaaaaatacaaaaattagccagggcgtggtggtgagcacctgtaatgccagctactcgggaggctgaggcaggaaaatcgcttgaacccataaggcaaaatttgcagtgagccaagatcacaccactgca

SEQ ID NO: 13274 - DNA, 126 bp, Homo sapiens
agtccaagcctcgtttatgtgagagtcccttccattaccacccccgacagcttctgctttcagcagtggtgagctttataaaattacctgttctggctgggcgcagtggctcacgcctgtaatccc

SEQ ID NO: 13275 - DNA, 82 bp, Homo sapiens
ggtacagcttactacatgcattcatcacatcatcaaacatgattatccaagccgctggactgccattgtggacaaaattggc

SEQ ID NO: 13276 - DNA, 502 bp, Homo sapiens
agacagattcagatgccacctttcctgtgagatgcaggttggcatagcagccactggggagctggtttcctgccatccacttgagagcatcctggatgttcttgggatcaatgaagatgaatttctgagcttggccaaagcattttgtgacaaacgctgtcagcctacatgggtaaagaggaaaatatggcatgaagaggaatttccaggtgagggtgcaatcatttcttcatttatttgggtgtatacttccagaaggggagctgagggaacatatgccatagcaggcctagaaaagagaggcattaatgggcaccaatgaggacaagaacaggggaggcacaagctcaggaagatcgagggacttgaccatccatgagggtgaaataaacagtattaaagaggtagaagactgagtgcaagaaggaaaggggttaaggggagaggtagtggaatagttccagagggctcaggaattatgctctggagtacagaactcatt

SEQ ID NO: 13277 - DNA, 441 bp, Homo sapiens
gatctagcattatattaaaggaacaatatatgattaaccaataacttccagaaattcagagatgacttgatatgagaaaatatatcagtgtaattaatcatgttaataattgaaaggagaaaaagagccagatgctgaaaaagaacttgaaaaaatcaacatctattttaaaaaaagatctttacaaaacttagggtagaaaagtaagtccttatcaatatgttatgcaatgtttattttaaattgtttatatgatacttaatagtatcatataaactttatacgatacaagcatccctgtcgaaatcaaggtccgaagaagagtcctcgttagcatgtgtatcatttaacattcttctggaatgtttagcctatgcaattagatttcaaaaagaaatcagaaacataagacagattactctttgatggtgatttgactac

SEQ ID NO: 13278 - DNA, 397 bp, Homo sapiens
ttcatgaaataatggctgttataatatatgaaaagttaggttaatataatccactttagaaggtaattttgaagatgtaaaaagaccacatatattgttaagtgctagtcagcagaagctctcttaacaccatgtcactgatttctgcaattaacctgccaactgatgccaaggaaatggtgaccacactgagccaatggaccattttctagcacctctgtccatttctcttctcatcagtttcttgccaagaatcaggtgtgtttgcttccaaacctgttttgtcaactgcacttgttattgtaattacataatcaatgaaatatcatgagaacaaatgaactgtatgtgtaaaagaaaatcaaattatgtctggaaaaaaattcttgataaagga

SEQ ID NO: 13279 - DNA, 130 bp, Homo sapiens
acattgccaggatcagcaaggacatggaggacagcgtggggctggattgcaaacgctacctgggcctcaccgtcgcctcttttcttggacttctagttttcctcacccctattgccttcatccttttacc

SEQ ID NO: 13280 - DNA, 376 bp, Homo sapiens
ttattggtatactacaatatgatttaacttttattttggggataaatagtagaaaaaagtgaaacagaatgaaggcaggtgttttttattctaatgatggaataatacagagatactggacgatctctagcagttaattattgtgacccatataaaattatacaggtcacagtataattctctattaccgtttttacaccagtaagtcttagataaactaagcatgcttatgaattatgtatacagttagaatgcattatttttacagaggaacaattgcttgtatgtactaacactgtactcttggcttgcctcaagttctactcattattttatataaaatactattaggctgggcacggtggctcacgcctat

SEQ ID NO: 13281 - DNA, 349 bp, Homo sapiens
ggcacgagggtaaaaggtggagaccatcattgtggaatcttgtattttctattaaggtttgtaatagtcctacaaacttgaacataaatttttaatatttgggaaggaacattcactgaagaattgataatagactaaaaaatatagctgttatcaattaatacatgatctgtccttgaacacatattcaccattatgtaaacctcacattatttcagcttatttattccacagataccaatagacatgttttcacattgtagcatctcccaaatcaaaatacttctaaaaattggtagtatgtcggccgggcgcagtggctcacgcctgtaatcccagcactttggga

SEQ ID NO: 13282 - DNA, 399 bp, Homo sapiens
ggaaccaggggctgcagaaccagcccctccccaatgaggaccccctctggacgcccctccccatggagaacaccaggagccacagaccccagaccacagagcacacaggggagggcacggggcggccggggcagggtgtctgctgcctcgtttatgggatttgctccgcgtctagcacactgctgcctgcagtgctcctgtcccctgcagtggctactctgggcctacgggcctaatcctggttggcatgaaaatgtcctgaggctactgtgacaaatttccacaagctgagtggcttaaaggaacacatttgatctcttacagttgcatgggccagaagagtctaaaaacagtcagcagggctggttcctcctggaggcttataggggctgaatccgg

SEQ ID NO: 13283 - DNA, 609 bp, Homo sapiens
ggcacgaggtatactttgacactgagaacaaagagacagttatatctggaatgggagaattacacctggaaatctatgctcagaggctggaaagagagtatggctgtccttgtatcacaggaaagccaaaagttgcctttcgagagaccattactgcccctgtcccgtttgactttacacataaaaaacaatcaggtggtgcaggccagtatggaaaagtaataggtgtcctggagcctctggacccagaggactacactaaattggaattttcagatgaaacattcggatcaaatattccaaagcagtttgtgcctgctgtagaaaaggggtttttagatgcctgcgagaagggccctctttctggtcacaagctctctgggctccggtttgtcctgcaagatggagcacaccacatggttgattctaatgaaatctctttcatccgagcaggagaaggtgctcttaaacaagccttggcaaatgcaacattatgtattcttgaacctattatggctgtggaagttgtagctccaaatgaatttcagggacaagtaattgcaggaattaaccgacgccatggggtaatcactgggcaagatggagttg

SEQ ID NO: 13284 - DNA, 601 bp, Homo sapiens
cgcttgttttaaagataattgctagatttatgttttagctttccataaaatgtaataacataaaataaaatataaataaaatatgaaataaaataaaagccatggggaaaaggtagggtttgattgctaataagaaatttcttggaaaagagactagctctcttttggttttccaaagtccacattttataacatttttagtgcttggtgtttgcttgtggtattacattagataaaaatgtatcacagtgttggtttatactggatgtttaaataggattcattgaaaggggtgtgttttctttctgaggaatacttactcagcattttcttcagaaagttacttgctgctaatcctttatggaggctctaggggaacatcattttcttgccttttccagcttctacaggctgtccacatcctcagctagtggccccttttcatcctttttttttttcttgaattatgagattttttgtactttgagttctgggatacatgtgcagaacgtgcaggtttgctacataggtatacaagtgccatggtggtttgctgtacccatcaacctgtcatctacattaggtatttctcctaatgcta

SEQ ID NO: 13285 - DNA, 527 bp, Homo sapiens
ggcacgaaaaaggatgatagccagaatgccatagatcacaaaattgagagtgatacagaggaaactcaagacacaagtgtagatcataatgagaccggaaacacaggagagtcttcggtggaagaaaatgaaaaacagcaaaatgcctctgaaagcaaactggaattgagaaataattcaaatacttgtaatatagagaatgagcttgaagactctaggaagactacagcatgtacagaattgagagacaagattgcttgtaatggagatgcttctagctctcagataatacatatttctgatgaaaatgaaggaaaagaaatgtgtgttctgcgaatgactcgagctagacgttcccaggtagaacagcagcagctcatcactgttgaaaaggctttggcaattctttctcagcctacaccctcacttgttgtggatcatgagcgattaaaaaatcttttgaagactgttgttaaaaaaagtcaaaactacaacatatttcagttggaaaatttgtatgcagtaat

SEQ ID NO: 13286 - DNA, 376 bp, Homo sapiens
ttgtcagaagacatgggaacacatctttaaaaacatgaaacaaaagaactgtcaactcagaattctacatagagcaaaaattgtcaagaatgaaagcaaaaaaaaaaaaaaaagaaccccttttggggaaaaaaaaaaactttaaaaatccggcccggggggggggctccccccttgaaccccaaccttttgggaggctgggggggggtggtcccgaaaatggggaattggaacccttctgggaaaccggggaaaaccccccctttactaataaacaaatattaaccgcgccggggggaaggcccttttgccccacttcctggaagcttagccagaaaatggggaaccccggaggcgatttgcagaggccgaaacc

SEQ ID NO: 13287 - DNA, 496 bp, Homo sapiens
tatgctgattttcccaatgctgaatggtatagcagctggtgaattttcaataagatacacttttctcctgttctagcaagttttgatatttgccatttggttccagaaacttattgtgtctatgttcctaaagcactttgactctgagagagaggacaaactgaacctgatatatgatgtttgtgccccttgacggaggctgaattttctgaacttgaatgatcaatacaacagtgtcttgctaaaaattgtctcgcagaaaatttttcattcatttttcttgatggcaagtaatgtattccttcatcagaacaattaaacatctttaatgatttttaaagacagggtgtaattacatgcacatgataaaaatttaagcagcaccaagggcgtacagtgaaaattaagtctctttcctgactggagatcatagtatgagtgtttcatggctcctttcagagagattccatgtctagcatttatacatgcacataaa

SEQ ID NO: 13288 - DNA, 521 bp, Homo sapiens
ggcacgagccctttgagatttctggctttttgtagggacctcagttccattttcccaactcatgggttctcaataccttaactatcttttatttgtcaaattccaagtcctcaactcacccaccactacctgacccactgcagtcaccacaccaccctacccactttcccagggatgctttatgattagcttaaatactcaccattctgatttgtaatgccgcccccaccccctttttttgacacctgggagtttccttttctttcttgtaagatcagcattacacaaacaagcacatttttcttattatactttatctagaaaacccaggtgtcagtggcagaagcattcctgaatttatgtagatcattgttttgctggaactggaaacctcctgaaacacagcagtggaattgcttgtaatcggctgtgtatatcatcaacaaaagtcaatattctattttttcaagtgtaatttaacataagaagttaaacatttaccattcaatttaaaactaaaa

SEQ ID NO: 13289 - DNA, 532 bp, Homo sapiens
ggcacgaggccatttgcaaccactgatgggaggaacagagagcagcatttcagaaccaggttctccttcgaggaacagagaaaatgaaaccagcagacagaatttgtcagatggaatttcactcttgttgcccaggctggagtgcaatgtcgcgatcttggctcactgcaacctccacctcccgggttcaagcgattctcctgccccagcctcccgagtagctgggattacaagcacctgccaccatgccagagtaatttttgtatttttagtagagatgggttttcgccatgttggccagactggtctcaaacccctgacctcagatgattcatccacctcggcctcccaaagtgctgggattacaggcatgagccaccaggcctggcccattctgtcttcttttctttcaacattcatagccccatatctaggcccttaaacatctcttcccttggctattgctatagtatcctaagtggtttcccttcctcttacacttccccttctagtacatactctctccttacta

SEQ ID NO: 13290 - DNA, 127 bp, Homo sapiens
aactgtatctatgttataatcgtaatggtaactcaatccaaaggacctagtcacaggaagtaacgtgtcgtacatatcagtcaatatatgggcctaagtagggacatactgtgatcttggtatactt

SEQ ID NO: 13291 - DNA, 592 bp, Homo sapiens
gccaaataggttgtaagcagttcagcaccttttgtcttttttagtaactaaaatctgcatttgatacagaatttccttcagtgtggtttctgcccttcacactttggtaatgagttttcctgagagccattctaggcaggcaaatgtctggttttaatagacagggtctttcagtcctttctgcaacttactagctgtgtgctcttcagcaagttgcataacttttcgaactcttaattttcttgtctgaaggaatgaagacgatgataatgatgtccatgtcataggtttgtcagggttaaagaaacaacgggccgggcgcagtggctcacgcctataatcccagcactttgggaagccgaggtgggtggatcacctgaggtcaggagttcaagaccagcctggccaacatggtgaaaccctgcctctactaaaaatacaaaaactcaccgggcatggtgtcaggtgcctgtaatcccagctactcaggagactgaggcaggagaattgcttgaacctgggaggcagaagtcacagggagctgagatcaagccattgcactccagcctgggtgacgagcgaaactttgtct

SEQ ID NO: 13292 - DNA, 50 bp, Homo sapiens
ggatgacctgtcagtattgaccccttgggctgaagcaattcgatcctctc

SEQ ID NO: 13293 - DNA, 583 bp, Homo sapiens
aggtaccaagtatgtatcggctactgtttgaagtggtgctgtgctggagttactaaacaaaacagacacaagtctctatttttgtgtaacagacatgcaggcaaaggatgacattaagttaagtttcaattaaagggaagattgtggacaagaaggaagatacactccaagcaagtccctcaatcttagaatagcttcttgggcctgctcccctattaaactgtgataagcactccacctgtctgcttatctgcaaagcaaaactgggtcttggaaaggactggtagactggtcttcatttttagcttacgctaataaaagagctgagcctgccgggggcagtggctcagtcctgtaatcccagcactttgggaggcggaggccagtggatcacttgaggtcaggagtttgagaccagcctggtcaatatagtgaaaccctgtctcttactaaaaacacaaaagagtagccaggcgtggtggtgcacgcctgtaatccctagctacttgggaggctgaggcaggagaaccgctggaactcggaaggcggaggttgcagtgagctgaaatggcaccatagcact

SEQ ID NO: 13294 - DNA, 324 bp, Homo sapiens
cagactccctggatttcactatggtggtcctgccatttattagccctacaattgtgatcaagtcactcattgctctaagcataagttaccctcatctataaaatggagtgataatagtacctgccacctagagatcttgtgagaccaaaataagataatccattcaacttttagcacagtgcttggcgcagagtatgctctcaatacacatttgctatttatcatgcaaaagcatgagggcaaggaagcataagatgtaatttaagaatactgagtaggccgggcgcggtggctcacacctgtattcccagcactttgggaggc

SEQ ID NO: 13295 - DNA, 529 bp, Homo sapiens
atataccgaagtgttcatgaaataaagcgtagaagttagtgcacgaatttgttctgggcgtttgttttagtattccagcattttgtttctattgctaactgatgagaaatgctttaaacacataaacatgttctgatgtgtatgtgtgagacttgcgtttcccaacgttgcataaaataagcacaaataagtgtaaaatagtgtaaaataactgcaaatagctttatcttacacagaaagacaggtgaacagctcgtctttaatcttaagcataacatttgttttggtaatcttataaagattgcttcttgcacatttttaaagaaaaaatgtgaaattaaacagattattaacgctatactagtcaatataccatatagtaacttcttgaaggacccttagcacagaactaagaaatgcaaaatcgttcttatttccgtcaagataaattttgacagaaatgtagcatttgaatctactcaaattgtatttccaagtccagtgaacggtagcaatgcacagttttatt

SEQ ID NO: 13296 - DNA, 514 bp, Homo sapiens
aagacttcctctaaagtggaactagcccaacctcggtgtacccacctcgaagtctcttttatatgttgagtttctaattattgatgctagtaccataaaatgaggatacaattatcatggcagccatgagtgaaatttttgtagaacaggatttattaatcatctgttttactgttcaaaaatctattagctaggactttctgccatgtgtataagcctgatttgtggaataagagaagtttggaagagtcactatataggaatcttccttttaagagggcatatgtttctaatacagggattttagctgtattattttggtctatatcgtaagtgtgctttttgtttaagaaacagagaaaaatgcttccaaagcaacagaattggaaaataaaaaccttggaccagttacaacagcagagaataaggatcagagcaaattggcatgtgtacatggtatcaaagggaccagtatttcttcagaagtaaacctaactgaaaggtaaaagagtga

SEQ ID NO: 13297 - DNA, 595 bp, Homo sapiens
agttttcatattccttagtgttatcacactggtgcacttactgttttaccattttcccttccgatttcatttttctgttagcatttactactatctaacatatattttactcatttgtctgtgttccccatcagaatataacttcatgaggggagggattttctattacacttagtgaaaagtaaatccctcaagtaggaacactacaagtatgcacagttttttttttacagtaagtttgcttaatggctagtaaactatctcagccagtacctgagtgactattctgacttgtatcatttaacaagaaaaaaggcctggcgcgctgtctcacgcctgtattcctagcactttgggaggccgagacgggtggatcacttgaggtcaggagttccagaccagcctggccaacatggtgaaaccttgtctctactaaaagtacaacaattagctgggcgtggtggcacatacctatagtcctagttacttgggaggctgaggcaggagaatcgcttgaacctgggaggtggaggttgcaatgagccgagactgcgccagtgcactacagtctgggtgacagagtaagactccatct

SEQ ID NO: 13298 - DNA, 398 bp, Homo sapiens
ccgttctggcccagcagaaattatatacttggcaacaagtctcatcacattttaaataaactgtcaaaaagataacattctcatgtttccgcaatttaattttaaaatgaaattaaatttttttgaaggtaaaatacattttggaaatctaaactgtttaactcttagaacgaacagtggaaaagagaaaatataactgaatgataaggaaaatatatacacatcagattgatgtgatgcagccaagtggcatgtagaagaaactctagtattagtataggtttttcctatactttccatgtagtatgaacattttatataagtattttaaatgcttatttaaaaaaggaaattacagagttaaccaaaacaaggatttgtagagaaaaggcatatgt

SEQ ID NO: 13299 - DNA, 451 bp, Homo sapiens
aaaccttagctgtagtgattggaattaacacttgggaagtcatgattgacaaatagagaaatataaatttgttttatatcagttatatatacatatttataactgatataaaacaaattagattttgacattagaaacacatatacacatactgtaatatgtactttcttcattctctttaacctatattctggttttaagtttcctggagcccgtggagtaatgggacaggaaggctcagagggtctctttactgatagttaagatacaaaaaaaactaggccaggcgcagtggctcacgcctgtgatcccagcactttgggaggccaaggcgggcggattatgaggtcgggagtttgagagcagcctggccaacatggtgaaaccccatctctactaaaaatagaaaaattagccgggcatggtggcaggcacctgtaatcccagctac

SEQ ID NO: 13300 - DNA, 227 bp, Homo sapiens
ggcacgaggggaagaatgcatctgagaatgatgagcgcttatctaacccccagattgagtggcagaatagcacaattgacagtgaggatggggaacagtttgacaacatgactgatggagtagctgagcccatgcatggcagcttagccggagttaaactgagcagccaacaggcctaagtgccaggttccctggcgttggtgacatgctgcagcctggaactctga

SEQ ID NO: 13301 - DNA, 130 bp, Homo sapiens
ggcacgagaaaaggagccagaacttgatgattttgaaaattctcagcctttctggttggcagagggtgatgaaattgagacacggcaaagatcaattcaagagccactccggggagaatggcggtctaaa

SEQ ID NO: 13302 - DNA, 483 bp, Homo sapiens
cgaattcggcacgaggtagagacggggtttcaccatgttggccaggatggtctcaatctcttgacctcgtgatctgcctgccttggcctcccaaagtgctgggattacaggtgtgagccaccacgcctggccggcttatttttatccacagtaaatcttcagcaactcattgtctccaccagatagtatttttctgtaaatgaaatgctgacttcgcctcttcctgctgtatgctcatccctgcactgagcacagatatgacaagcagtagccatgggggaggtgggtgacaaagataggaccccgggagggggcgcaggtacatgctagtttcaattaccacagtattctagagacgggttgcaatgacaaggggggcaaatgaaatcaatgcaagatttcttaataatgggcagacagaaaaatgtaaaaccacacaaaacggactgctgataatattttaaaatatacttatttgtcttc

SEQ ID NO: 13303 - DNA, 403 bp, Homo sapiens
ggcacgagctcattttattttgcatatattaaattgagtaggttcagctctaacataccttaagaaaaatgcatatcggtgcactgtatgtatttcaaaatgcctttcctatgattgtcatgtcctcctttaaggcttttccctcaaatttattacaaatttagtatttttagtacttgatgactctaattacatgaatgcacctggaatgacatttgtaacagaagacagtctgacttgctttcagtattcacaagttctttccagtttccaagtcttttcctagcagtaatttaggggagacagaggagtttcatgtaaagagcatgcagtttggagtcagaacctgggtatgactctgtggccttgatgaagcaagttacttaaactcttgagttttagc

SEQ ID NO: 13304 - DNA, 397 bp, Homo sapiens
ggcacgagctctctctctctctctctctctctctctctctctctctctctctctctctctcggtatctctctcggtgtggagctcttctccaacatctggggagctgggaccaagactgcccagatgtggtaccaacagggcttccgaagtctggaagacatccgcagccaggccttcctgacaacccagcaggccatcggcctgaagcattacagagacttcctggaacgtatgcccagggaggaggctacagagattgagcagacaggccagaaagcagcccagggctttaactgcgggctgctgtgtgtggcatagtggtcataccgacggggaaaggcgacctgcggtgatgacgacgtgctcatcactcacccagatagatggtcccaccgg

SEQ ID NO: 13305 - DNA, 413 bp, Homo sapiens
gaggctggttcagaaaaggaggaagaggcccggctggcagccctggaagagcagatgatggaggggaagaagcccagggtgatggcaggcaccttgaagctggaggataagcagcggctggcccaggaggaggagagtgaggccaagcgcctggccattatgatgatgaagaagcgggagaagtacctgtaccagaagatcatgtttggcaagaggcgaaaaatccgagaggccaacaagctggcggagaagcggaaagcccacgatgaggcggtgaggtctgagaagaaggccaagaaggcaaggccggagtgagtgcctgcggcccctcacagggctgatgccagcccctagcagctggatgtggcagaggcaggccagaggacctaagtgtgatggaccagagtcacttc

SEQ ID NO: 13306 - DNA, 223 bp, Homo sapiens
gagggttcttgaagcttttgagattaacaatggcaggaaaatcatcactttttaaagtaattctccttggagatggtggagttgggaagagttcacttatgaacagatatgtaactaataagtttgatacccagctcttccatacaataggtgtggaatttttaaataaagatttggaagtggatggacattttgttaccatgcagatttgggacacggcagg

SEQ ID NO: 13307 - DNA, 481 bp, Homo sapiens
ggcacgaggttcactcaacatcctgagaaagaaaatgaaggggacattacaatttttcctgaaagtttgcaaccttctgaaacgctaaagcagatgaatagcatgaattcagtaggcaccttcttagatgtaaaacgtctcagacagttaccaaaattattttaaccttttaactccctgcccttttaatacagggacagggtgtctcctgaagatacttagggaaaacaggagcctaccacaaggctcctgatcattctggagtcactgtttcttggtagcagccaattgggaagagtgacttctgtgagatggctggctggtgataggactaagttctcattgttcaaatagagctgttcaacatcactgaaacctttaagaaaagccctgagatcagttattcctacaagtttaagtagtagacagatactatccagctctaagtctcaactgctcttttatactgtacttttttttt

SEQ ID NO: 13308 - DNA, 509 bp, Homo sapiens
ggcacgaggtggcccataagttttaccttttaaacatccggctgcctgtgaatgagaagaagaaaatcaatgtgggaattggggagataaaggatatccggttggtggggatccaccaaaatggaggcttcaccaaggtgtggtttgccatgaagaccttccttacgcccagcatcttcatcattatggtgtggtattggaggaggatcaccatgatgtcccgacccccagtgcttctggaaaaagtcatctttgcccttgggatttccatgacctttatcaatatcccagtggaatggttttccatcgggtttgactggacctggatgctgctgtttggtgacatccgacagggcatcttctatgcgatgcttctgtccttctggatcatcttctgtggcgagcacatgatggatcagcacgagcggaaccacatcgcagggtattggaagcaagtcggacccattgccgatggctccttctgcctcttcatatttgacatgtgtgag

SEQ ID NO: 13309 - DNA, 404 bp, Homo sapiens
tattcggcacgaggcactatgaaagggaaggaaacgcttcagggctttgtaactgacatcacagcaaagacagcagggaaagctctgtcactggtgattgtggatcaggagaaatgcttcagtgctcagaatcctccaagaagagggaaacagggagcaaataaacagaccaagaagcagcagcagagacaaccagaggccagcatagggtccatggtatccagggtagacgctgaagaggcattggtggatctgcagctacacacagaagcccaggctcaaattgtgcagagctggaaagagctggccgacttcacatgcgcattcacaaaggctgtggctgaggcgcccttcaagaagctccgagatgaaactaccttctccttctgtctggagagtgactg

SEQ ID NO: 13310 - DNA, 464 bp, Homo sapiens
ggcacgagggtgcccatcaccacacccagctaacttttgtatttttagtagagacggggtttcaccatgttggccaggctggtcttgaactcctgacctcgtgatccgcccgccttggccccgcaaagtgctgggattacaagcatgagcccagcgcctggctgtatctttcattttacccaagtcactttacccaagtaagtaattaggggaaagcctgagtcttgtaccacctgttcatttggggaactgtgggaaacggagccaacggacctaagtgccctttgacagtgagtttcataccatttcagtagtgtatttctttcttaatctgaataaaccagaatgatactctcagcacagaagaataaagggagcgagtcattaacgttttctttttaaacctttatgatgacttccttatgaattactgaacgaacactggaatgggactcaggtatcct

SEQ ID NO: 13311 - DNA, 177 bp, Homo sapiens
gagacggccctcggtaagggatcagtggggcagggggaaggcggcacaatgaaaaacggagtgagaaacaggaagctttctccgaaaggagaagaagataagagtggacgaaggaagaactcgagatggtgggatatgttctgagggagagaatggagggtggaaatgcacaaagag

SEQ ID NO: 13312 - DNA, 548 bp, Homo sapiens
actccaggctgagaaagagaattaggaggcctgaggaggggccgaggaaaggctgttggggtgtgctggggttggtacccgagcgccttcccctcacctcaaccagagaagagcatccggttgctttttaaagcttttagcctgccctagcaaggacaaagcatgttagattagagatgcttctgctgatcgcaggggttcttatttgaaaacatctatgatgggggtggggtgggaggagacaggttgtggttatgcaggaaaatcttgtcctaaaaatatatgagtttgggggtaaggggtgggatagccaagcaaaatcagtaattattttaaaatgaacatatgtatttttattaacttttagttaaatacagattttacaacgaggtcagcataagcctaaatctatatagagggctaactcaggcattgtcttgtttatttgtagactggattaaaaacaacctgtcctgttttgtcagttcccagcttcttcgtttagaataaattagaccaaaagaagaaacgtgcttgtctctgtatac

SEQ ID NO: 13313 - DNA, 244 bp, Homo sapiens
aaattgatgtctgacaaagatcttcttacgtgtagtaaatgaattctgctctccaaatatgaagtgaaactgcatcaattcaagaaatgcctacaatcccttcagcatggtggttccactgaaaggcccttaagaataacggatattttactcacatgttttgagattagtagaaccgtcgtggctttatgtgtctatttagttactacattcagaaaactgagggtataaaacaaactttaac

SEQ ID NO: 13314 - DNA, 68 bp, Homo sapiens
gtaagtcacaatctctttgaggctctattttgttaactataaaatagggacagtaatgtctacaatat

SEQ ID NO: 13315 - DNA, 251 bp, Homo sapiens
actaaaaatacaaaaattagccggacgcagtggcacgcgcctgtaatcccagctactcaagaggctgaggcacgagaatcacttgaacccgggagggagaggttgcagtgagccaagatcgtaccaccgcactccagcctgggtgacagagtgagactctgtctccaaaaaaaaaacttggctggaatataattttggccttacaggggatcattctagtaggaaaggacaataaaattttttatcaaaat

SEQ ID NO: 13316 - DNA, 86 bp, Homo sapiens
gatttctataatttctaaaaactcttaatacctgccaaagctgactccacagggagcagacttgttcccatttttccacagtcccc

SEQ ID NO: 13317 - DNA, 369 bp, Homo sapiens
atactgaaggtaatagggcaggctggttccatcagggctgagaggcctgctgaagatccttccacaagagctgttccttgagtctgtgtagacagttggaaattaaagtgagagaggagaaggaataatgaaggaggctgccatttaaaaatgtcttgcctgaaaactaggccgggagcggtggctcacgcctgtaatcccaacattttgggaggccgaggcgggcggatcacttgaggtcaggagtcgagaccagcctggccaacatggcgaaaccccgtctttactaaaaatacaaaaattagcaggacgtggcacacatctgtaatcccagctactcaggaagctgaggcatgagagtccgttgaa

SEQ ID NO: 13318 - DNA, 207 bp, Homo sapiens
ttctcagaaggcttatctgatgatccactcacctctccttccaccttaagggaagaatggaagataataagcaaaacttctagaaagagcaattagcccttcaacttctaatatccaggtggttcagttcccagtgagagaggtaagtgggcaatggtaagctgtgccacacaccaggtatcttatttttcaagaatagctttcttg

SEQ ID NO: 13319 - DNA, 379 bp, Homo sapiens
agctatatataaacaacctgcaacaggagggtcgtagaacccagaagcattagtcctggaggacttcctgaaagaggtgagttttggctaagttcctgtcaatgatgctggcatagactataagagaggaggctgggcacagtggctcatgcctgtaatcccagcactttgagaggccaaggcaggcggatcacctgaggtcaggagttcgagaccaggctggccaacatgaggaaacgctatctctactaaaaataaaaaaattagccaggcgtggtggtggacacttataatcccagatactcgggaggctgaggtaggagagtcacttgaacctggtaggtggaggttgcagtgagtcaagatcatgccactgcac

SEQ ID NO: 13320 - DNA, 342 bp, Homo sapiens
tgcatctcttgttatcttctgtgaagtgagtcagtttcaactttgcctttgtgcttatgtgtcattctctgctctttgatgttcaagtctatattggttccagactctgttttatttaatctgtttgttttctttctaaaaacatattctatattcccgttcaagagtggagctaacttcacaggatttgggaaaattctgattattctagcccatacacagaatgcccaggacaaggaagacaccacttctctgaggaattgtgccaagaatacaagtcggtgaagtcagcatgcacatgttgaatgtttacaatgtgccaggtactttcatatactattc

SEQ ID NO: 13321 - DNA, 423 bp, Homo sapiens
atatgccaaattttgtattataattcaatctgtatgacagttatgtgagtttttttttgttttgttttatgcttgtgtgaagatttttgtagttaagctttttttaaaaaaaagtcaactgagttacttacgtgatgaaattagaacacatacttcttacaagcacattctctcctatccccctctccatttcagttggcaccataatgccatttttgcctaaccataacataaattaatatcattttattttatggagtttttctttctgggataataacatttctgctttgttgcataattatcacagacaggtttttctttttttggagatggagtcttgctctgtcacccaggctggagtacagtggcgcgatcttggctcactgcaacctctgcctcccaggttcaagcaattctcct

SEQ ID NO: 13322 - DNA, 348 bp, Homo sapiens
aaaaacaaaaattcccataaaaaaaatagatgtttcttacatgttgagcatatatggatttcatttttaatatgattgtagaaacattagatttaaagcatattgaaaaagaaaacagtatattctttaggagcttcaaaaaagggttttggtttagttcaaagggtgaaagaagatcttttattattttggtaaataacttctaaggaaacaaaccaccctcacatgcactatctcatttgtatttctgtcaattctgaaaggccagcatttggccagtattatttgaatctgtattgtattttttaaccagaagaatgaaggtttatagcttcattcttttggaag

SEQ ID NO: 13323 - DNA, 510 bp, Homo sapiens
tgtcagaatcagaaagtgttgaagaagaaaatattagttacctaaatgagagttctggggaagagtgggattcctctgaagaagaggactctatggtgcccaacttatcgcctcttgagagtcttgcctggcaggttaagtgccttttaaaatattccacaacttggaaacctttaaatcctaattcctggttgtatcatgctaaactgttggatccaagcacaccagtccatatacttcgagagataggtctaagactctcccattgttcccattgtgtccccaaactggaaccaattcctgaatggccccctctggcctcttgtggagtcccaccttttcaaaagcctcttacaagtcccagccggctctctagagatcatgccactctaaatggagcactgcaatttgccaccaaacagctaagccgaacattgagtagagccactcccatacctgaatacctaaaacagatccctaattcatgtgtttctgggtgttgctgtggct

SEQ ID NO: 13324 - DNA, 300 bp, Homo sapiens
aatagcatgagcgtcaaaaacaggctgattcaaatcctgttatccagatgcaagtggttatgtactctaagcctcagtttcatcatctgaatatagatatggtacttatcttacaaggttgtgataactaaacataataatgtatataaggcatagcatagcatttggcacatactaggtgcccagtgtgtagtaattgctgtgactacatggtataccaccttcctctccctgagaaatctcaggatattggacacactgaactactccattctaaaccttaaaaataaaaacaaaagg

SEQ ID NO: 13325 - DNA, 517 bp, Homo sapiens
  misc_feature 117: n = A,T,C or G
tgacatcaaacaaaaaaagactctgaacagcaatgaaaattatcaaaaaatgaaaaggcaacctacagaatggaagaaaatagttgcacaccatatatctgacacagagttaatatnccgaaatatataaggaactcctacagggagtgcaacttgtagtagcaggctaacccttgcagtagtaggttaaccaagatcacacaactaactaaaggcagagctgggacttcaacagagtctattgacaccaaaatctttgcgcccttaaaaccttctcaaaacttttgggaagggctaacttttgaggtaggcataggaagaggaactagtgaaaagtggccaaggcagagtttcaaggaggtaggaaacctcggaattactgataatgaaggaagaggacatcccaagtggtggtacagaaggggctgttcagggctgtctcaaggagagaacaaaagagtgagtgtcgcctgtaatcccagcactttggcaggctgaggtgggcggatcacctgag

SEQ ID NO: 13326 - DNA, 123 bp, Homo sapiens
gtgatctgcccgcctcggcctcccaaagtgctgggattacagacgtgagcacccagcctggatgttgtttttgatgacactgctaagcacttatgtgagggattgtttgggtggtttgggtct

SEQ ID NO: 13327 - DNA, 493 bp, Homo sapiens
tgccacctccgcctcccgggtttaagtgattctcccgcctccgcctccggagtagctgggatgcgccaccacgcccagctaatttttgtatttttagtacagactaattttagggcttcaccatgttggtcaggatggtctccatctctttaaaagtgaatgaggaacttccttgagaggagacgctgcactgattttatggagactcaactcctgaccactgggatgggccattcccttctagctggggctgttttaactgctcccttcgagggcaggcatcagctgagtttggtccggatttcctttctggtttttggttcttgcgaaagtgcttttcttgtgtaaatagttgttaaattggtgtccttgctggagagacgatctgtggagcattctgcgccgccatcttgctttgcctcccacctcagcattgcttttaatggcctcggtggcagctgggattttatccctgccacgtgagatggatatt

SEQ ID NO: 13328 - DNA, 452 bp, Homo sapiens
ttctagagtcagatgtttcacaactatgtcatctttctgttgaatagtctatttcaaatactttattccaattatgcaagataatgggatgaagctcctaaaagttggaacgttaaaataaatatttttttgttgtcatcctgagtgttctgcacttaggaggcattaagcggatgttgctgcatgactgaaaaatggggaatctatgcttaagaacttgataaactaccatgttgcagttttcagtaatagactgaaaatgtaataataactcatactggccgggcgcggtggcttatgccggcaatcccagcactttgggaggccgaggtgggtggatcacgaggtcaagagatcgagaccatcctagccaacatggtgaaaccccatctctactaaaaatacaaaactaagctgggtgtggtgggacgtgcgtgtaatcccagctactc

SEQ ID NO: 13329 - DNA, 423 bp, Homo sapiens
catccacattttattggaaaaatattattttataaatggagaaaagcctggaaagacctctaccaaaatactaaaggtgctttttctggatggtgcatttataaatgttgttaacttctttatgttattcaatggacatgcattttgtgagcaggaatgattatatttaaaaatctgagtttgaatgccaatttgatcgtgtctcagctgtgctatctttggcaagccacttcttttccagagttccaatttctacacttctaggactggggtaataaagtcattttcatagcattgttctgagaaagaaaatgagatcatgtgtatgtgtattgtgtgtgtgttgtgtatgtgtgtaccctgaggctagatctggcacacttttagagcaactccagtatgatggccacacacagacactct

SEQ ID NO: 13330 - DNA, 401 bp, Homo sapiens
tacggctgcgagaagacgacagaggggccatttgagaacttacagcaagagaaaactctcaaggaaaacaaagcttgatctgcaaaggtcacgtgtgtacctacgctgggggaagagacctttccaaagctctttttgtgtactggaaaaaactcattacctgttcttcagtatgggaatagtcaaataaatgaggacccagccccataataaaatactatgtagtcaccaaaaagaatgaggtaagaatgtaggagtactgactgggaacaatgctgatgatacagttttcaatgcaaaaagcaagttccacaacaatatacagagtacaatcctgattttcgtaaaagaaatacaatttaatcaggatacatacatatgtatgtaattatacatatgca

SEQ ID NO: 13331 - DNA, 386 bp, Homo sapiens
cttaatggaggcagatgttagcagggatgaaatacaggtgcctgtgctggatactgaggatgcgtggctctccgtggaaggaccaatctccatagtggaactggcccttgaacagaagcacatccactacccactggtggagcaccactccatcctgtgctccatcttgtatgcagtcatgaggttttctctgaagaccgtgaagccactttcactttttgacagtaagggaaaaaatgcatttttcaaagacctaacttcaattcagttattacctagtggggaaatggatccaaattttatttctgtacgacaacagttcttattgaaagttgtcagtgcagctgtccaggcccaacattcagccacaaaggtcaaagatccca

SEQ ID NO: 13332 - DNA, 500 bp, Homo sapiens
acccacggagaattatctaccaacaatatgcatcatagaaatttagaaaacagaagaaaagtcactacagtcctaccactcttactgttaaggtttttgaaatatatagagttttagccataaatataaatgatttcatatagcatgtattttataaaaattggtttatactgtacattctatcttgtgatgtgatgtttttcacctgccactgtatcatgcccatttccctctctctgctgtctgtattcttcttgatgtggtgaagcatctttgcccaatcttctgttcccttgtgccctgctctctgcctaacatttaattgtactaagtatacaatcagagttttagaggttgaagagcagagatttcagatcatctggtccaaccttttcatttaacatgtgtgttaactttctcatttaacataattacatttcactgagaccttctggaaccaacaagaaaaccttaatatggaactggcatgatgggaattt

SEQ ID NO: 13333 - DNA, 100 bp, Homo sapiens
tatgctctgtctctttcacttaggccactctggcaaaatacatccatgttcaaataggtatgaactgcttctttttatgagctaataagcagtgagtatg

SEQ ID NO: 13334 - DNA, 304 bp, Homo sapiens
tgtcttttgaatagtgtgcctttaatagaacacatatagcatagttctagggattagagtcttctgacttcattactatttttacagtaatttatatcttggtttcttcaattagaaaaaaaaatcgggcctgattttttatttcatttactagctcagctgttctcacacctacctgctgaattagaagggacaagtataatccatcttcttttcttctttccctccttctgtaataatgtttttctattttgcaggggtaattttttttttttttgaaaaacccgttttgttttgcccccca

SEQ ID NO: 13335 - DNA, 434 bp, Homo sapiens
gtaagaaattcttctttcaaggcagttgtcttcgtatctatcattttaccatacctggttaaaacagagtcccaggtacatattaaagcaagccttcatacatgttggccctctatctaaaagcctcttcccactcctttccctttacctggtaatccctgttattccctagatgcctgctttaaagagatttcctttggtaaatcaccctgaaccctcagactagtccagacctctctttgatattttcctcttgacattcagcatttatcccaattgaaagtaataattacatttgtgtagttattagattatctgtcttccttagtaaaaagtaagcttatgggctgggtgccatggctcatacttataatcccagcacactgggaggctgaggcaggaggatcacttgaccccaggagtttgaaaccatc

SEQ ID NO: 13336 - DNA, 369 bp, Homo sapiens
cctagagtcatcctctgtgctgtttcgtgagttttgcagcggagacttcaccatccggaggagctgtgtttctgtgtcacttgggatatcaccttaaaatatcaaatgtttcatgtcgacgcggccgcgaattccagatctatgaatcgtagatactgaaaaaccccgcaagttcacttcaactgtgcatcgtgcaccatctcaatttctttcatttatacatcgttttgccttcttttatgtaactatactcctctaagtttcaatcttggccatgtaacctctgatctatagaattttttaaatgactagaattaatgcccatcttttttttggacctaaattcttcatgaaaatatattacgaggg

SEQ ID NO: 13337 - DNA, 469 bp, Homo sapiens
ggcacgaggtttaaagaaaacatacaagggtatgacggagatatgattaggagagggaatgctttttgagggcagaattgccaatctgcttgtactttataagcctgttgattgtttagatacggtttagccagtttatagttaccctgggtgctgaaaggtatgctggatgatacctaaccaacagagaaccattgaatgccgttcaaaatggactgaagcatcagcaatgtctgaaaaaggcctgacagtaatgtacatgtcaaatggcccgtaatttaagcagagtagagtaagtagaagaataaacatggggaaagttccagcaacagaggaggctttgagcttttgctcttcatcttgagtggatgttgttctcaggtggtaataggccatcgagctttctccactggctgcctctctggggaacaaataaccgaaaagatactcagcaccctggttggtacat

SEQ ID NO: 13338 - DNA, 529 bp, Homo sapiens
gccgccccactcgccccagccgccgccatgaaggccgaggtgcagcgcgtaacccgggccagcgtcacagttggaggagagcagattagtgccattggaaggggcatatgtgtgttgctgggtatttccctggaggatacgcagaaggaactggaacacatggtccgaaagattctaaacctgcgtgtatttgaggatgagagtgggaagcactggtcgaagagtgtgatggacaaacagtacgagattctgagtgtcagccagtataccctccagtgtgtcctgaagggaaacaagcctgatttgcacctagcaatgcccacggagcaggcagagggcttctacaacagcttcctggagcagctgcgtaaaacatacaggccggagcttatcaaagatggcaagtttggggcctacatgcatgtgcacattcagaatgatgggcctgtgaccatagagctggaatcgccagctcccggcactgctacctctgacccaaagcagctgtcaaagctcgaaaaacagcagc

SEQ ID NO: 13339 - DNA, 490 bp, Homo sapiens
ctatttaaaagtttcattttcttttgcaattttagttttatgtactgttaaagaattgtactgaattctttttagatcacagtaaaaataggttggcagagatttcagtttcccagggcttaaccagaaccgccacctcaatgcattgtcagtagaatacattattagaaactgttaaggtctttcccgggacatttttttctgccattttcttttgcaattgtagttttatgtaccgttaaagaattgtattgaattctttttagatcaaagtaaaaataggtcagcagagatttcagtttcccagggcttaaccagaaccgccacctcaatgcattgtcagtaggatacattattagaaactgttagggtctttcccaggacatttttttttctgtatcatgtctccccatcattgaagcgcaaattttcttgaattcaaatactcccaatgagcttgtatacttccaaacagctaaacttgatttcc

SEQ ID NO: 13340 - DNA, 388 bp, Homo sapiens
ggcacgagggacagtagacaaaagagagagagaccgaggcagagatagagaaaaaaggcccaaagagagtcccctcaggccaactttggttttcacttctcagttctgagagccgaggaagcaggaaggagctgtgagaaactgagctctaaccttggccatcaaagacaagctgtgcagctctggttttttgagggcaggacatggagggtcaggcccagctggaggcgcaccaaagcccagagaaaattcagaaccacgtgaacttgttggatttcagccccttgaagcacatgttgctattgcagctgccttgataactggggggacaggaggagcacggctttcccatcttgtacggggactcgccaatccagttgcccctgga

SEQ ID NO: 13341 - DNA, 399 bp, Homo sapiens
  misc_feature 399: n = A,T,C or G
ggcacgagagaaaacctcctttgggagaccaatgtgggacaatgagttttctacaatagctacctcccaccccaagtctgtagtgggagttttcttatgtggccctcggactttggcaaagagcctgcgcaaatgctgtcaccgatattccagtctggatcctagaaaggttcaattctacttcaacaaagaaaatttttgagttataggaataaggacgggaatctgcattttgtctctttgtatcttcagtaatttacttggtctcgtcaggtttgagcagtcactttaggataagaatgtgcctctcaagccttgactccctggtattctttttttgattgcattcaacttcgttacttgagcttcagcaacttaagaacttctgaagttcttaan

SEQ ID NO: 13342 - DNA, 358 bp, Homo sapiens
  misc_feature 358: n = A,T,C or G
cattcattatcaggaagttttagttatctgtcatttttttttttcacatcagtttgatcaggaaagtgtataacacatcttaaagcaagagttagtttggtattaaatcctcattagaacaaccacctgtttcactaataacttacccctgatgagtctatctaaacatatgcattttaagccttcaaattacattatcaacatgagagaaatcaccaccaaagaagatgttcaaaataatagtcccatatctgtaatcatatctacatgcaatgttagtaattctgaagttttttaaatttatggctatttttacacgatgatgaattttgacagtttgtgcattttctttatacan

SEQ ID NO: 13343 - DNA, 573 bp, Homo sapiens
cagattgctgggtcctacccaagagtttcatctgcatttttaccaagttcccaggtgacactgatgctacaggctgaggagccacactttgagaactactggtccaaagaaggctgctcagagctgcttctagtcagattcagtggcctgcaggtgaaggggtaggtgtatctggagccccacctgaagtctggcctggttttcagtgctctaaaagggatgatcaagactaaggattttaaagttaagaggaggctggactcagtggctcacaccagtaaacccagtgctttgggaggcccaggcaggaagatccttagaggccaggagttagaggttacagtgagttatgattgcaccacggcactccagcctgggcaaacagaacaagccccatctggccggatatggtggctcacgcctgtaaccccagaactttgggaggccaaggtgggcggacaacttgaggtcaggagtttgagaccagcatgccaacatggtgaaaccccgtctctactaaagatataaaaattgatcaggcatggtagcacatgcctgtaatactaagtactt

SEQ ID NO: 13344 - DNA, 72 bp, Homo sapiens
aatgccccaactaaatactaccgtatggcccaccataattacccccatactccttacactattcctcatcac

SEQ ID NO: 13345 - DNA, 241 bp, Homo sapiens
tacggttgcgaaaaaacaacaaaagggtacggctgcgaaaaaacaacaaaagggtacggttgcgaaaaaacgacaaaagggtacggttgcgaaaaaacgacaaaagggtacggctgcgaaaaaacgacaaaagggtacggctgcgagaagacgacagaagggtacggctgcgaaaaaacgacagaagggttcggctgctagaagacgacagaagggtactgttgcgagaagacgactgatg

SEQ ID NO: 13346 - DNA, 500 bp, Homo sapiens
aacactaatggccctccctggaacagacacggcgcccccccacagaatagcctcgatgccccctggaacagcctcggtgccccctggaacagcctcggtgccccctggaacagcctggtgctcctggaacagacacagcccccccagaacagacacagcaccccctggaacagcctggcgcttcctggaatggccacatccccccatcctttctgtgctgctttaggcatctgcccttacgtggttcgtgtccagctctgtcaacaaggccagctccacaagaggccccagctcagccctccccagtgggctcccctactcaggctctgggtcagcttcttcccaggaggtgtcctggcccctgtgctggccccgcctcgctgcctggacacctgtccgtgccaccctggtcactgagcaggacatccgcgtctgtggcccctgggaccctgcccccgacagccaggcctgggtttgtccttttaggtagagtgcctggt

SEQ ID NO: 13347 - DNA, 324 bp, Homo sapiens
  misc_feature 188: n = A,T,C or G
tttacatagtacaactgctttatcctttcaaaagcagatacgtcaatcaaaacttgacatttatttatctatatttatgctgagttcccttaaaatgttttgtctttttccatataaccaatcatattatttcctaaaaataaacttaggtattgtcacagggataagaacttctgctttccatactngtgtgtggggattttgggtttgttccgtttttttgagatgaggctcactctgtcgctggctggagaacaggggcgctatctggctgggattacggtgggagcaacgcgcccagcctgttttttttaaaggggatcc

SEQ ID NO: 13348 - DNA, 332 bp, Homo sapiens
gacgacagagggggcctcctgagtacctgggattacaggcacccgccaccacgcctggctgacttttgtctttttagtagagacggggtttcactatattggccaggctagtcttgaactcctgacctcaagtgatccacttgccttggcctcccaaagtgctaggattacaggcatgagccaccacacctagccaggattcccaatctttatttgccttgaggctgatggaaaattgctggagttctacctgggattcttaatataaactaacatatatacatatacaaatatatatgtgtgtacatataactgtaaaaaatagtgcgggc

SEQ ID NO: 13349 - DNA, 157 bp, Homo sapiens
ggtaaataaggatacttgtggctgggtgcggtgggtcacgcctgtaattccagcactttgggaaaccgaggagggaggattgcttgagcccaggatttcaagaccagcctgggcaacatcgtgaaaccccatctcaacaaaaaatacaaaaagaaaa

SEQ ID NO: 13350 - DNA, 235 bp, Homo sapiens
gattacaggcgtgcaccaccatgcccagctagtttttgtatttttaatagagatgaggtttcaccttgttggccaggctggtctcgactcctgacctcaggtgatccactcaccttggcctcccaaagtgctgggattacaggtgtgagccactgcgcccggcctactacatacatttctaaaaaaaaaaaaaaaaaaaaaaaaaaaaaggggggccgttttttccggaaaccca

SEQ ID NO: 13351 - DNA, 230 bp, Homo sapiens
cagtttgttcttaaagttaaactaatggggaaaaaaaacaggacagggaggtatctcaagttcatttgagccatttttaaaattttggtagctggtttctgtttttcttctttttaaaatagtaacaacttaggattttgtgtgccaccagcttccattccatttcataaaagcttaatctagcaagaattggtgagccctagtagaagttagaaagaaatgttgaagtg

SEQ ID NO: 13352 - DNA, 444 bp, Homo sapiens
tttactttgaagagcactaaaattagagccgtcctgcttttaaggcaaggaaggtgggatagcagatgcagggctgggagagttcatgtaatcagtgtcccccttatccatgggggctgtgatccaagacccccagtggatgcctgaaacctcagatagtactgaatcctatatatacactgttttttttctagaaatgcatatctgttataaagttgaatttataaattaggcacagtgagagattcacaataactaaaaaataaaataggccaggcctggtggctcacacctgtaatcccaccactttgggaggctgaggcgggaggatcacctgaggtcaggagtttgggagcagcctggccaacatggcgaaaccctgtctctactaaaaataggaaaattagctgggctaatttttgggtcacaggcacctgtaatccc

SEQ ID NO: 13353 - DNA, 410 bp, Homo sapiens
aaacccaaaaatactactgtaagtatataagaacataattgaatgtgaaattgttctgttttatgtaaattatgtttaaagctaataaaggggaaatgtagaaaattataaagaatttaagaaataaggccgggcacagtggctcacgcctgtaatcccagcactttgggaggccgaggcgggcggatcacgaggtcaggagatcaagaccatcctggctaacatggtgaaaccccatctctactaaaaaaaatacaaaaacttagctgggcatggtggcaggtgtctgtagtcccagctacttgggaggctgaggcaggagaatggcgtgaacccgggaggtggagattgtagtgagccgagattggccactgcactccagcctgggcgacagagcaagactttgtctc

SEQ ID NO: 13354 - DNA, 514 bp, Homo sapiens
acccctttcctctcccgggacacagctagagtgctgtgagcttgtcggtgtgccgtttagtgtccttctgaggtctcatgtggccttgctctctccccagctacaccgcgagctctttgagagcacggaccaggtctccggtttctctcatacccctaaaggctcggcacagagctctgctctgaagaggggcccagcgagggctgctgtctggccatggcggtcatatttctacctgagtgctggactctggggcccaagaagccccaactcatgttacacaagaagccggttggctataaaatgtggccgggcgcagtggctcacacccgtaatcccagcactttgggaggctgaggcgggtggatcacctgaggtcagcagttcacaaccagcccggccaacatgatgaaaccccgtctctactaaaaatacaaaaaaactagctaggcgtggtggccggcacctgtaatcccagctacttgggaggctgaagcagaagaatcacttgaac

SEQ ID NO: 13355 - DNA, 463 bp, Homo sapiens
tgctacttcccagggactgagctggcgttggtgagggacaggcagaagccatcctaccatgggtccaggcctggcgtgcctcccctccaccagtggcttccccacctctgtgctggggagctcactaattcacatggcactggtagaaaacctggaattgtctgaaagtttcttcttctatttattattatttatttatttatttattttgagacatagtttcgctcttgttgccctaactggcacaatctcactgcaacctccgcctcccgggttcaagggattctcctgccccagcttccagagtagctggaattacaggcatgcgccaccacgctcagctacttttttgtatttttagtagagatgggatttcaccatgttggccaggctgctctcaaactcctgacctcaggtgatccacctacttcggcctcccaaagtgctgggattataggcatgc

SEQ ID NO: 13356 - DNA, 163 bp, Homo sapiens
gaaagttatttttctagttcaatttcataccttgttaatataattcttattaacgatataaccgatcttacaatagagtatggtaaaatcagatgcctccaatgagaacttgctgcagcatcattcctctcttctctctgattctgatttataaaaacttaac

SEQ ID NO: 13357 - DNA, 127 bp, Homo sapiens
cctgggcgacagggtgagactccgtctcaaaaaataaacacataaaaataaaaaaataaaataaagaacattaggtgttctttgaatgaaaaggctggggtgtaaataatgccttgactttgctgct

SEQ ID NO: 13358 - DNA, 464 bp, Homo sapiens
gtttaagatctgggtgctggcatggtccatttctggtgaggtccaccttctaggctgcaaacttctgacttcttgttgtagcctcatgtggtgaagagcagagaggagaaacaagctctctcgttactataatgagggcactaatctcattcatgagagctctgcccttatgacttaatctaatcctcattacctcctgaagtccacagctccttatccatcagggggtaaggtttcaacatatgaattctggggtacacagacattctgttcataacaggtatgtaatgacatttactttctaaatggtatttgaatgttgttttgtttattgaataaccataaaccaaggagttaagggttgcagatgctgtaaaccttatttaacagatgaagcaggctgggtgctgtggctcacgtataatcccagcattttgggtggctgaggcaggcagatcacctga

SEQ ID NO: 13359 - DNA, 364 bp, Homo sapiens
cgacagaagggtacggctgcgagaagacgacagaagggtacggctgcgagaagacgacagaagggtacggctgcgagaagacgacagaagggcagtggctcatgcttgtaatcccagcattttgggaggccaaggcgggcggatcacgaggtcaggagatcgagaccatcctggctgacgcagtgaaaccccgtctctactaaaaatacaaaaaattagccgggcgtggtaacgagcgcctatagtcccagctactcaggaggctgaggcaggagaatggcgtgaacccgggaggcggaggttgcagtgagccgagatagtgccactgcactctggcctgggcgaaagagcgagactccgtctc

SEQ ID NO: 13360 - DNA, 545 bp, Homo sapiens
aggcagggtttcaccatgtgggccaggtgggtctcaaactcctgacctcaggtgatccacctgcctcggcctcccaaagtgctacgattacaggtgtgagacacggcacctggctaataaatttctatcatctataaattacccatgtctaaggtattttgttaccacagcccaaacagacagcatttcatatcagcacatacagaactttctcatttttttctttcactgtgtttagggttgcccgataaaatacaagatgcctacttaaatttgaattatttgcatttccaatacagaaaaagaactttttagtgtaagtttgtcccatgcaatatttgggacatacttatgctagaaagttatttatttatctgaaattcaagccagctgttccgtatttgtatttgttaaatctgaccacccttgttaccttatatgggagctccttattttaaatcactgggggcttcaggaaccaggtgcctggacttggtgggtgtccattctctgactgtattctgaattaggctctagaggctcca

SEQ ID NO: 13361 - DNA, 265 bp, Homo sapiens
agaaagaagggattagaggagcacagaaagtttaaaaaggactgacaatattgtacctcttgagctaagtagtgggtgaatgagtgttcatgttattagtcttgtttaggttgtacatatatcttatgcatgctctttttatgtatgatacatttcacaataaaaataaataaataaataaaatttttatttaaaaaaaaggttgctggccacaaggtcatcatagaaatagtgaaattcctatatataagtaatcacaaattaa

SEQ ID NO: 13362 - DNA, 367 bp, Homo sapiens
ggcacgaggtttaatctctttaactatcaaattgcaattttttttttgccttgcaaataaacaaattacaattgtcatttactggtgagacaatgagaaaaagacaccctcaaacactgttggtagaacacaaattgttaaaatctttctaggagtcattttcaaattatgtatcaatgacctaaaaatatttatgtctcctgttcttatacttccagaaatctattctacagtaataaccggagataaaaacctttacatataaacatgatttattatactgaaaagtcaaaacaacataaatattaaaaataggaggtggtagatttcacctttaaatgctatgtaggagaatacttaagggatt

SEQ ID NO: 13363 - DNA, 300 bp, Homo sapiens
aaaattatcaaaccatcctttgctggcattaaatattcaagttgaagatccttcaccttcctttaatcctatattagagtctataggtgtgtctttcttatagcaatcctgcactcacataaaaactggattttcaatataagatcaaaatgtatttcacaaaaaatgcatctttatatttggttacatttctcctgactgaatggtgccatgtacagtctgtgtaagttatagaaaacgtttgccaactcgtagtctaccattttggtatttggtttctatttggttcgtctggtcttt

SEQ ID NO: 13364 - DNA, 460 bp, Homo sapiens
agcttaacataacctatgagagtggacaggtgtatgtaaatgacttacctgtaaatagtggtgtaacccgaataagctgtcagactttgatagtgaagaatgaaaatcttgaaaatttggaggaaaaagaatattttggaattgtcagtgtaaggattttagttcatgagtggcctatgacatctggttccagtttgcaactaattgtcattcaagaagaggtagtagagattgatggaaaacaagttcagcaaaaggatgtcactgaaattgatattttagttaagaaccggggagtactcagacattcaaactataccctccctttggaagaaagcatgctctactctatttctcgagacagtgacattttatttacccttcctaacctctccaaaaaagaaagtgttagttcactgcaaaccactagccagtatcttatcaggaatgtggaaaccac

SEQ ID NO: 13365 - DNA, 260 bp, Homo sapiens
gttgctgtcacttggatttctagctttgggagcctgttccacctactcagctctgcattgagcagtatgggcacatgccctgtggacagttactggacgttaatgaactcagaggagaaaagcagtgagccacttgttctgtgtgatttatggtacttcattgctcttccttcacctctagtcactttctattgctacctgccctacattggctcctgccaaggtccctctctctccctgttttcctttttttttttttt

SEQ ID NO: 13366 - DNA, 561 bp, Homo sapiens
ggcacgaggccacggcgctcggcctgaattttttttaatacttaatttagatcaataacttcgactggtactgaaatttgcactcactttcagcttacagtttgggtaggactgctagacccagttcttttgtcatctcattcttagagagctcttgaaaaccaaagtatttaaaaccctgcaagtttctgtgcagatgagtgcaaatttccacccagcattggttcctgagtaattagaggaaggaagccatgcaaaagctgctattgcccaggctccagaaaaacatcatgtaaggtttgattccatactaattgttcaaagtgtaaaagaaagctgactgtggcagtttttacctccttttcttttttttccttttaaaaataatccagagacattaagcccaacagtttctctttgcttttttccctctctagcacattttcttgatgagtctaaggtgtgacctctactgaaatggctcccacccaccttctcctatggaagtggatccccagccccatctccttggacctcgtggctgtgtttagaaaattagca

SEQ ID NO: 13367 - DNA, 457 bp, Homo sapiens
ggcacgagctcaacccctgcactgcgctagtcctaaagaggaaatgtctctacgctgcggggatgcagcccgcaccctggggccccgggtatttgggagatatttttgcagcccagtcagaccgttaagctccttgccagataaaaaaaaggaactcctacagaatggaccagaccttcaagattttgtatctggtgatcttgcagacaggagcacctgggatgaatataaaggaaacctaaaacgccagaaaggagaaaggttaagactacctccatggctaaagacagagattcccatggggaaaaattacaataaactgaaaaatactttgcggaatttaaatctccatacagtatgtgaggaagctcgatgtcccaatattggaaagtgttggggaggtggagaatatgccaccgccacagccacgatcatgttgatgggtgacacatgtaca

SEQ ID NO: 13368 - DNA, 455 bp, Homo sapiens
ccactctcggaaccttgtcctgtttgtcccccagctcggcaagcgccatatgagcctggcggcgccagatgcgaatcctgttctgggctttttggcctattcccgcccctcagtcttgccgggatggcaccgcccgcataggacttccagggttgggctgagtgggagttcgactgctgggcctcgtaattctcgctttggggctgctccttccaggctgggacacactggggcccgctgtcggtctcccgtcctccgacatcttgtctggaacttccgcctggcagtctccagtaggagtggagctctgtgcggcgtagtttggtggaaaaacgggccttgcgtcggcctcacccccagtgtttgtgtttcagaatgaagactattctcagcaatcagactgtcgacattccagaaaatgtcgacattactctgaagggacgcacagttatcgt

SEQ ID NO: 13369 - DNA, 185 bp, Homo sapiens
cattgaattaataattcagtggctcctcgggagtcgaatgggcatttgggacaccagaaggaaaagaaatcatcatagtctaaggttcagttgtagatcaaaaaatgcagccaggccgggcacggtggctcacacctgcaatcccagcactttgggaggccaaggcaggcggatcccttacactc

SEQ ID NO: 13370 - DNA, 392 bp, Homo sapiens
cgttgctgtcggtttatccttctgcaccacttgtttcccacctgggacctccagcaagaagcaggtgggcttagagaacttgctgtatttcgggacactgaacgtgtagatggttctggcactgaggcagtggtgttcgctggcagctggctggagagtgatctggactggctggccatggggagtgactggaaatagggtctgtttggaaaagaagcagagagtggcagagctgctgtggggactggtttcacacagccaggacagagtggggttggcagacatggtagggtgcttttttttggttttttctgattttttgtacgggataaggcttggttctgtcacccaggccaaagtgcagcggtgtgagcacagctcactgcagcctg

SEQ ID NO: 13371 - DNA, 525 bp, Homo sapiens
tgtagactttatgtcagttctgtgtagactttatgtcagtttttgtcattatttgaaaatctattctgacaactttttaattcctttgatcttataagttaaagctgtaacaactgaaattgcatggatcaagtaagcatagttttatccagggagaaaaataaaaggaagccatagaattgctctggtcaaaaccaagcacaccatagccttaactgaatatttaggaaatctgcctaatctgcttatatttggtgtttgttttttgactgttgggctttgggaagatgttatttatgaccaatatctgccagtaacgctgtttatctcacttgctttgaaagccaatgggggaaaaaaatccatgaaaaaaaaaagattgataaagtagatgattttgtttgtatccctacccatctcctggcagccctactgagtgaaattgggatacatttggctgtcagaaatataccgagtctactgggtataacatgtctcacttggaaagctagtacttttaaatgg

SEQ ID NO: 13372 - DNA, 439 bp, Homo sapiens
ttcgaattcggcacgagagaagattggggatgaggagtgaggagaatgctggagaccagttagaggctaccgtagcagcgtatagaggctgaaaatctaactagggtggaagcagccaggcaggctggtcctaatgttgggagttgttcagatctggacgagaggtcattacttatagagttattaatttataccccaccttaattgcaaagagattcaaagcagtaagccatcactttagaatttaatgttctgttttcctttttatttactcattcagcagctatttcaatgcctgctgtgtgccaggtgctattcttagtgctttacttgttgtatgtgttatctaatgctgtgtaacaaattactcctgaacttaccaactcacaacaacatttattagctcacagtttctgtggagcatggatctagatgtggc

SEQ ID NO: 13373 - DNA, 422 bp, Homo sapiens
tgtgaaagaaaaagctcagtgatgctgagagtcaattggtgtaacttgatgagccgaaatcccccgcaatggggaaaacagagtcctagaaagatgagagggaaggtgagtcagccagcctagtggggctgttattcctaagctgggttgtatgtcagaatcactcacagcattcttaaaaacacaggcctagcctgtgagactctgaggcagctgttggatttgggccaggacacagtggatctacttttaaaaagctcctggttgggctgggagtggtggctcatgcctgtaatcccaggactttgggaggtggaggtgggtggatcatctgaggtcacgagtttgagaccagcctggcctaaatggtgaaaccccatctctattataaatacaaaaactagctggacgtggtggtgggt

SEQ ID NO: 13374 - DNA, 452 bp, Homo sapiens
cttgtttttccacacagtggagctgtaactgcactaacatggagcaaacagatttccaaagattaagattcagtacaattatgagtggagaatatgacaagtaagttatctggtttactccatgtgaccactataagggaaataattcatcaagtttaatttgaaggtctcaggatgttgaaatcagacttttacatcttaatccactgagaatgaaaaatgaactacttatagtgtctgcccatgacaagtcatttctttgcttatggatgcaaatcgtatcacacagtggtctgaaatattcctttcaaagatataagctgtttgtttttcaaaatggagcttccaggtgtgctaattctgaacacgaagctttgttatttggagaagaatatccttttatggtggtactaaggtagttggcaaatatttactaatgcatactttgtgct

SEQ ID NO: 13375 - DNA, 82 bp, Homo sapiens
tatgttatatgttatgaaaaagtcaatccatcaagaagttagaaaaattataaacatagatgtgtaacagtgtgagccccaa

SEQ ID NO: 13376 - DNA, 574 bp, Homo sapiens
gggggacagagcgagactctcttgaaaaaaaaatacgtatatagaaaagtttaatcgtgggaagtgctgtaaaggaaggcacatgttactctaagagtaaagagcaggggaaacaggagggcttttcagaggaagtgccctttaacatgaggcctgaggagtaagtgggagccagccagcgaagggaagggcattccaggcggagggaacagcctaggcaaaggcctggaggcagagagagccatcagccttccctcctggactgcgagttctctgaggttccacacttttatgtctcccctgtgccctgcaaacaggtgccactgcattgatgcctggtggaatgaattgattccagaagggagggaaccgggagaaaccagctccctggattcctccccgctggggcggagcaggtttgcatgcccaaacttgcccccagatttaagcagctttccttggtcacgtaatcaggaggatgggatttgacaaatgtttgccagggtttccatgagatcaggcaaagccgcgggtaaccccgaggatgggcccctttttccaccctccgcaagtt

SEQ ID NO: 13377 - DNA, 494 bp, Homo sapiens
ggcacgaggggaaaaacggaaaaaactcaagagtgaaaactaagtggtgtgtgaaaatgtcattgtgcctgggtggttgaagtcattaaagtcagagagccaaaaatacctaacagagtggagcgaaaaaagagccggacagaacagtgagaataatatatcactgatgtaaaaacaactcatatgatgcttgtaaatgtggaaactataactatccctggaggggtatagagatgagttcaattaggagggaaactgagtgacaggaggacaaaattggaagggagatttttactgtataactttgtatcttttaaattttgttccaggcgcatttatcatgtattcaatgcatttaaacagaagaggagaaggacgggccataggatagaactattggttaaaaccatcttgtctcaagcccaagctgtcatttgtgaactatgcttcttatggatatctgttgtttgtctgccatttccataccctgcttt

SEQ ID NO: 13378 - DNA, 320 bp, Homo sapiens
ggcacgaggtgagaacggagatacgggaaaacccttggctcatggaagcatagccaacataaaccttttaagcaaaccagcgcaggagttccgtcatagtgcaccatcatcagaaaccagggctcctggtgttccagaagttgccacactttatgttacttcatccacttggtggggaaagcttttgaaatacatcatacatgcatttgtttttaatcagagtgcgttggccatgatgggggtaatttatactgagcacatggcacccatatctggggtttccctcttggtcagggcccccattggccagagcagagtcg

SEQ ID NO: 13379 - DNA, 483 bp, Homo sapiens
cgaggactctttattcctttgcattttctttctcagtctgatctgcttcctgacttcctggaaaccctccaaatttcttgatttctaatggcactctttctagatttctagccctgtacgataatattctttcatcatttcagtgggcttttggagggaggcggagatccaggtgatctgtctacactattcagtcagaaagctggatggtttttctcactgtttagctgtgactcatacttagaaagtggtttaaatgtgaatatcttagttctggttgtacaattgaggtaatcctcaattcaggttgctgtctggacatttcatgactggatttaaaaatatttttaaggccaggtgcggtggctcatgcctgtaatgccggcactttgggaggccgaggcgggtggatcacctggggtcgggagttcaaggccatcctggccaacatgctgaaaccccgtctctactaaaaatacaaag

SEQ ID NO: 13380 - DNA, 536 bp, Homo sapiens
gtctgggcggttgctggcagcgccatggagacggtacagctgatgaacccgccgcgccggcagctgaaaaagttggatgaagatagtttaaccaaacaaccagaagaagtatttgatgtcttagagaaacttggagaaggattactgtagatgcagtatatggaatcaggaatcttaacttcatgtgagctattggagttttccttgctatcaggatgcatagggaggtcctatggcagcgtatacaaagctattcataaagagaccggccagattgttgctattaagcaagttcctgtggaatcagacctccaggagataatcaaagaaatctctataatgcagcaatgtgacagccctcatgtagtcaaatattatggcagttattttaagaacacagacttatggatcgttatggagtactgtggggctggttctgtatctgatatcattcgattacgaaataaaacgttaacagaagatgaaatagctacaatattacaatcaactcttaagggacttgaataccttcattt

SEQ ID NO: 13381 - DNA, 466 bp, Homo sapiens
acgagggggtttcaagaacgtgcctcttgggaaggacgtccgctacttgcacttcctggaaggcacccgggactatgagtggctggaagcactgcttatgaatcagacggtgatgtcaaaaaaccttttctggttcaggcacagaccccaggaagcttttcgggaagccctgcacatggacaggtacctgttgctgcacccagactttctccgatacatgaagaacaggtttctgaggtctaagaccctggatggtgcccactggaggatataccgccccaccactggggccctcctgctgctcactgcccttcagctctgtgaccaggtgagtgcttatggcttcatcactgagggccatgagcgcttttctgatcactactatgatacatcatggaagcggctgatcttttacataaaccatgacttcaagctggagagagaagtctggaagcggctacacgat

SEQ ID NO: 13382 - DNA, 565 bp, Homo sapiens
gatcaataggcggagggaaattgtttctatatgcacttattaaataatttttgttaacaaccctgccctgggataaaagtgaatggaagtacatgactgagtaacagtaattaattctttgccttgttcgtttatttggggactgtatatgctttcttgactgacaatagaatgttgtattacttttcattgtgtctttatttgcagttcacagcacttttgttttgcatatgctacaaactaaaagtttagcaattacgttatattccaattctggagtccagattgtacaaattagatgaaattctaattcgtcattttaggaagaaatcaattacctaaaattactggctcttttcaacataccctttagtatgtaaaaaaataagcttcaaatgcgtgggttaaagttaactatcaatcccagtttaagaatgatatttctgtaagaaaactgctttattttccaagtcgtagtatttaacataggctgagtcacaaataagttttttaattgtatcttaatgcagttgtctctgcctttcaagtcactttgattgaaaca

SEQ ID NO: 13383 - DNA, 227 bp, Homo sapiens
gtgggtggaagaagagcttccaaaagtatctaaagaggatcaatcaagagggtccgtgctcggccgggcgtgttggctcacgccagtaatcccagcactttgggaggccgaggcaggcggatcacgaggccaggagttcgagaccagcctgatcaacaccgtgaaaccctgtctctactaaagatacaaaaaattagccgagtgtggtggtgtgcacctgtaatccc

SEQ ID NO: 13384 - DNA, 444 bp, Homo sapiens
cagtatgcacaatgttgaaacagagttgataaacaaaaggtgactgatgttcactatcatcttttttaggaagtcaagtaagtttgtgatatagtttacagatacttctatcaaatattaaaatgtcttaagatggaaaaaaaaacagttttgacactcaagtaggttttacatattaacatatatagaatgcacatagaagaaagggtcagagaggtccctggaagtgccgtgtactgattcagcatcatgggggctgcacagcctgcactgtgagtaataactataataatagctatcatttaatgagcatttaccatgtgccaggaattaggttaaatctttacatgaattatagtattgagcccttttatccatgccttgagtaggtattattatatctattttaaagataaggaaattgagggccgggcacggaggctc

SEQ ID NO: 13385 - DNA, 615 bp, Homo sapiens
gaaatgcttaatttataagcgggctggagattttttccaatattgttttctttgaaaatgaaaggggatcatctattttagttttggggtctgggaactttttgaaaatttaatttgtggaccaatgttttgtgaaagctaaagagggcaggggttaaaatagggcttgaatttctcattctgtatagaccagcaaacttccctgtgcaaggcaagtttacatcacaaatccaagaatgtttgcatcctaaatgctagtttgcttcagcccctagttaacctcaggacttggtttgcatataaaaggtagacagctgatatgttttcatgaataaatattgtcagccagaaaaggttggtgtcaggtaatgcatatttttttaagctttgttttatatttatttttcatttagtttttattgggaatggttttcaaagaactctcagttctgcctaggtgtttttgggggagccctgttttccatagtgtaattccatttaagaggttgtctaaaagtctttttaattaatagaaagattttaatatccaagagtagtcaaattaaggatataaactttccacaccttcctgtcgtgacagataaaagcacagaa

SEQ ID NO: 13386 - DNA, 565 bp, Homo sapiens
gggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaa

SEQ ID NO: 13387 - DNA, 200 bp, Homo sapiens
ggcacgagcagccttggtgacagagcgagaccctgtctctaaaaaataaataaataaaatattgtgagtctctgatggggagcagtattgcatggtggttgagaactgaggctctgatgttagaactggattctgacttaacccactgtttgcccacatcttgagccttggtttccctatctgtaaaatggcagtattct

SEQ ID NO: 13388 - DNA, 93 bp, Homo sapiens
agcccaggtttttaataagatgaaaaaaatgctgttataaaaagtgaaaagaggccaggtgtggtggctcctgcctgtggtcccagctactcc

SEQ ID NO: 13389 - DNA, 300 bp, Homo sapiens
caagaagaaacatggcggctatccttctctcacatcgaaaaggaaattttgaacaatcatggaaaatctaaaacgtgctgtgaaaacaaagaagagaaatgttgcaggaaagattgtttaaaactaatgaaataccttttagaacagctgaaagaaaggtttaaagacaaaaaacatctggataaattctcttcttatcatgtgaaaactgccttctttcacgtatgtacccagaaccctcaagacagtcagtgggaccgcaaagacctgggcctctgctttgataactgcgtgacatac

SEQ ID NO: 13390 - DNA, 530 bp, Homo sapiens
tgacgtgaaatgtaaactagtaggcgtgttattgatctgctaaaactaaccctctttttaagaggagatttaaggaagacgtcaatcaaaatgtcaaatatgtgtgtcagaatataaataatttttcacattgtattgttgctatataaaaaaaataatagaattggttgggtttctgaggtgaaatccagagtaagagtactagacagttcaacaagccacatctaatggcacagatagaggatgtagctattttatacctttcataacatttgagagtaagatatccttcaggatgtgaagtgattattaagtactcatacctgaaatctgttgtcaagattagaactggggttcatgttaaaaaccttccatattacctgagggtacctgtggggaacagttccttcccctgtgtggtagtattttgttggaagagaatgtttatacaaaaaatgaaattcttccaacagcagagaaactctaaaaagtttgatagtacctatcaaagtgctgtacttctgtgatag

SEQ ID NO: 13391 - DNA, 197 bp, Homo sapiens
  misc_feature 197: n = A,T,C or G
acgacagaagggtacggctgcgagaagacgacagaagggaactggagcctcatctctcaatttatgcaaaaatcaactctaggtgaatcaaggatttaaatctaagacatgaaactataaaagttctagaaaataacatcagaaaaattcttgtagacattggcttaagcaaagatttcatgacaaagaaccaaaan

SEQ ID NO: 13392 - DNA, 214 bp, Homo sapiens
atcactgttctgcttggttttaaaaaattcaaaggccaggcgcagtggctcacacctgtaatcccaacactttgggaagctgaggcaggtgggatcacctgaggtcaggagttcgagaccaacctggccaacatggtgaaatcccatctctactaaaaatacgaaaattagcccggcgtgatggcgggcacctgtaatcccactacctgggaac

SEQ ID NO: 13393 - DNA, 521 bp, Homo sapiens
agacacactgaagcattgcatttgaatcataattatgaaccatttaaaaattggggatttattttttaattatgaaaaattctgttgtaatagtaccacatccaatttatatgttattagctgtttgttacccactatttcattatattggaatgagggcaaataatcctgtaggcaagcacgatattttaaaagttaggaattctgacacatctcaacttttaaatctaatagattgatatgctgctgaaagaatatttactctctggagacatatctgaagctgaacattgccttaaggaactggaagtacctcattttcaccatgagcttgtatatgaagctattataatggttttagagtcaactggagaaagtacatttaagatgattttggatttattaaagtccctttggaagtcttctaccattactgtagaccaaatgaaaagaggttatgagagaatttacaatgaaattccggacattaatctggatgtcccacattcatactctgtgct

SEQ ID NO: 13394 - DNA, 358 bp, Homo sapiens
tctagactctggtcgtcaggaacgggtcaaggccttcaccatgagaagagcaccaaagggagttaatatggggttgaccagaggtaggcaaaggaaggcctgtgggccaaatctggccagctacctgtttttataaataaagttttattggaacacaaccatgctggggtttgattcatatttcctgaggctgttttcacactgcaatggcagaggtgagtggttgacacagatgccgtctcaccaaagcctatgatatttactgtctggccctatacagaaaaagcttgctgacctctgggttagactgtcaggtggtagagactaaggagggagtgataagtccctgttggccacc

SEQ ID NO: 13395 - DNA, 135 bp, Homo sapiens
cctctgggctcccgggcccggccagatgggccagctccacagggccctcgcccctgtctgtggcaggattcccaaggccgcccctgcctggctctcccaccttccccaggaccctcttcctctcgtgtctggctt

SEQ ID NO: 13396 - DNA, 612 bp, Homo sapiens
gtgtatataattacatatcccagagccagagaggattagaagtgctacagaagtgaatgtcaggcaatatgatattccacaggtgtgaaagtagcgtttctacagagttggccaacactctctaaatcaaaaatatctgctgccgaatggggggagaaagaaagtgaagtgaatcataaactagagtcaaatgggataggagagacagtacagagtagtcagcccagcagatcatacaaacctgactgcccacaccttgctccaaaggttgagtcctttatcaaagggacgtgtgatttaaattgaaataatacgtttaaaaaaaatgattttaggcccggcgtggtggctcacgcctgtaatcccaacactttgggaggctgacgcgggcagatcacaaggtcaggagatggagaccatcctggctaacacggttaaactccgtctctaccaaaaaatacaaaaaaaaatagcagggcgtggtggcaggcacctgtagtcccagctactcgggaggctgaggcaggaggatggcgtgaacctgggaggcggagcttgcactgagccgagatcacaccactgcactccagcctgagtgacagagcgagactc

SEQ ID NO: 13397 - DNA, 543 bp, Homo sapiens
ttttttacctcttcataatgtctaacacaatgatggtcatatttggccagccacctgattattatttgttgatttatggacttttggaacttctagatgatccagatcttttgtagttaattactcactttggggaaactctaaaaaaaacaagtgtttattgagcatctattatgtataagccataatgctaggtgctagagaagctacaaagatgcaaaagacatgggagtgcctgcccttagggagttcacattctagttgggaagataggcttgaaaaatgagtagcaaggaaaggcttaagtgacaactacgtagaacaataaaagagacatcaaaaaggtaatgtcagtttaacggccaaatgatttttctacatgcattcagacaagagaaagatcccttctgttgggagcaatcaagaaaggttttgcagagaaggtgggatttgagccgaaagaaaattaggatatgaggagggtaagaaagagtgtattccaagtgagaaacaggctcacttggtgggaaagagtggtgggaa

SEQ ID NO: 13398 - DNA, 577 bp, Homo sapiens
agccttctaactggtcaagtcgaatgtgactccagaggaagagcacaggactgtgagtcgaggtcacggtctaatccaagttctgctaccaagaaaatgaacctgaacaagtcacttaaactttctatgtttccagtcttttatgggggaaatgaaggtaataatacctgccttctacctacctcatgggaatgttgttgagtataaaagataagctatatgaagcattttgagctttttggaagaaaagagatatggaaaagttaattatacatttacgtaaacttaatatataaaagaggagaccttggctgggcatggtggctcacgcctgtaatcctagcactttgggaggccgaggcgggcagatcacctgaggtccagagtttgagaccagcctgaccaacagggagaaaacccgtctgtactaaaaatacaaaaattagctgggcatggcggcacacgactgtaataccagctattcgggaggctgaggcaggagaatcacttgaacccgggacgcggaggttgtggtgagctgacattgcaccagtgcgctctagcctgggcaacaaga

SEQ ID NO: 13399 - DNA, 569 bp, Homo sapiens
atggcacttaagatttcaataagttgagaagtatagtatgacagttaagactaaaagagtaaaagtgtccacttcagtcagagccccaacagtgttttgacaagttgatcttaaaattatactgaagggcaaggaccacgaatcagctataattctgtaaaagaagaaggatgatccatactaccaggtatcaatgcttatttcaggctagataattaaggcataagatatttactgatgcaaggaaagacagatacagcaatgggacaaatacatgagctcagaaattaatccaaagcatataaagaaatgtgatattacaggaataatcatagaaatcaataaattaaaaatgggctatttagggccgggcgcggtggctcacgcctgtaattccagcactttgggaggccgaggtgggcggatcaccaggtcaggagatcaagaccatcctggctaacacgatgaaatcccatctctactaaaatacaaaaaattagccgggcgtggtggcgggcgcctgtagtcccatctattcgggaggctgaggcaggagaacggtgtgaacc

SEQ ID NO: 13400 - DNA, 601 bp, Homo sapiens
agtgctgggattacaggtgtgagccaccacgcctggcaggatttggaaatatttttgctgcttgctgattccacctaacctcctcttttctgacccacgcctccaacacacatatatctaagattctggatactggtaattaatcaccatggtaattagaagtgtttagcagacaactctttgatgcatcaaacaattttagtgagagagatgtactttctgtattggtttagagtatacaagtgccaatttcctacagcaaataatttattcacataatttggctgcataaaaactaccatatgtaaagtggtacagccactgtagaagacagcctggcagttcctcaaaaaattaaacatagaattaccatatgattcagcaattccacttctcagaatatactcaaaagaattgacaccaagaacgtgaacagatatttgacaccagtgttcatagcagcattattcacaatagcaaaaatgtggaaacaacccaaatgttcatcacctgatgaatggataacaaaatgtggtatacacatacaatggaatattatttactcacaaaaggagtgatattctgatacatgctacaacat

SEQ ID NO: 13401 - DNA, 94 bp, Homo sapiens
cctttagccacactagatgctacctctaactctagctaaaagactgactctgactattcctcactatgctacattctgaatgtaattacaaaac

SEQ ID NO: 13402 - DNA, 300 bp, Homo sapiens
cccaagcaaggttccttggaagaagatgtctgcagaggagctggagaatcagtactgtcccagccgatgggttgtccgactgggagcagaggaagccttgaggacctactcacagataggaattgaagattatcttgaaaacaatcttccagtagttctgacgatacttggagcctggtccacgtgcatcccaccttgggaagcctctccaaagagctttcggagctgacactgacagcttcagtttcccccagcacccaggagagccttgctgtgtctgtctgcccggcaagagtccat

SEQ ID NO: 13403 - DNA, 548 bp, Homo sapiens
ggcacgagcttagttccacaaataattattgatttgtttaagcgtgatgtatgtgcttgctcaaggaattagaagatgagtatgacaaagctcattccctcagggagttgagtgtttcagagggatgaagtaaaagaagattttaaaactacaagtagagtgtaagaagtatcacgagaaacatcaacaaagggctgaggatagaaggtgataagtctcaagtatctcaagatattcagcagtgaatcttaacataaatttgcttttaggggaagaatttcaagcatattgataggtcttaaattttctagtctctctgggatagtaggaaggagaatgatttttaaaaagttgattatgtagcatggagtttggggactagtaaaaattttattgaaattatttgggaattgttttacagttgtttttagtggaggttgtatttctgaaaatattgcattttagtgtgatgatttactaaagaagtagcagggacttattctaaggtaggagatagaaaaactaataagtaaaaatctgctagcaac

SEQ ID NO: 13404 - DNA, 226 bp, Homo sapiens
ggcacgaggcagaaccttttcccctctactcttgtctaaaagttctgtgtggcacacagagatgcgacctactcaatctgacttagtaaaaccatgctgtagaatttttgtcttaaaaagaccacatacccagcacccatgaaataaaagattcatctgtaattgggattcaaagtgattaaattcctttgttcatactcataaatagcactaaagtgttataaca

SEQ ID NO: 13405 - DNA, 395 bp, Homo sapiens
  misc_feature 395: n = A,T,C or G
cgttgctgtcgattcgctgccccgagtcgggcgagcactatgaagtcacgttgctgcactttctacaggaatacctctgagcctgcccaccgggagccgccacatcacagcacaagtggctgcagcctccgcggggaaccaggcgggagggactgagtggcccgcgggccccagtgaggcactttgtcccgcccagcgctggccagccccgaggagccgctgccttcaccgccccgacgccttttatccttttttaaacgctcttgggttttatgtccgctgcttcttggttgccgagacagagagatggtggtctcgggccagcccctcctctccccgccttctgggaggaggaggtcacacgctgatgggcactggagaggccagaagagacn

SEQ ID NO: 13406 - DNA, 79 bp, Homo sapiens
tcggaaatggaacattttcatgattgcagtttgaaatatgctatacaggagtcaacgctgcacaacatggacaaaacta

SEQ ID NO: 13407 - DNA, 138 bp, Homo sapiens
aggaagagcagaaatggggaatatttggaagcggaggctgctggacacagagacctcctgttgggggtagtacgtggagacagaaccctgcttctgggcatcctggggtagtactcacaggggcagggggcccaggca

SEQ ID NO: 13408 - DNA, 347 bp, Homo sapiens
  misc_feature 261: n = A,T,C or G
ggcacgaggaaaaggccccagaatgggctggcttgaactggaaaaacacactttctcatcccttttggaccacgagcttcttgagagcaaagcatgtgtttgatattcctttgctcaccctcaggccttgtttggcaaattgcctgggatacagaaaataaggacaaggtctgggtgtagtggcttatgcctgtaatcccagcactttgggtgaccaaggcaggaggatctcttgaggccaggagttgcagaccagcctgngtaacatagtgagaccttgtctctgcaacaaaatttaaaaattagccagacttggtggttcccacttgcaatcccagctatttggg

SEQ ID NO: 13409 - DNA, 644 bp, Homo sapiens
ttgactcgcttgcttccctagttcttaatcacaggctcaggggactctcagcacctctccttcctccaggtaagtagaagcctgtaccacgtcgtaggtggctccttgggtcgggaagcaggtgctgccagcccgggacgcctcccaggggacattagctaccttgcgggagagcctgcgtgtctggttggtgtgcggagaaacattgtcatctagtggaagaaatagcaacgctctcatctcttttcttagctaatggcgtgtaaccatggattggatgtttacagagccatctcactgttgggctgatcacattgaaactttcctgggaaaagttcttatcatcttcttcctaccttaaattttgtacttcagtaaatttaaagaaatacaattgggcacttcaggccgggcgcggtggctcacgcttgtaatcccagcactttgggaggccgaggcgggcggatcacgaagtcaggagattgagaccatcctgcctaacactgtgaaaccccgtctctactaaaaatacaaaaaaattagccgggcgtgctggcgggcgcctgtagtcccagctactgggaaagctgaggcaggagaatggtgtgaacccgggaggcggagcttgcagtgagccgagatcg

SEQ ID NO: 13410 - DNA, 542 bp, Homo sapiens
gcagcgtgatcatgggaataccgcttaacctcaaatccttggctttctctgtaaagtaaatgtaataagatctccacagggtttgctgtgagggttgaacgagctcagtgcacatgaaaatgccctatacactcgaaaccagctataaatattggttattattgttaggatgctgacgttcaaatataaattgccaaaatcatttgggaagcattgcatactccattcccacatggagagttgcagggcatgtgattatctgtttgttcatttagtcacaatattgatcaatatagaacaaagcagtatattttaaaaatcaaccaggagcagccattctttgaagtgttatgcaaccattaaaaattaggtttggccaggcgcggtggctcaagcctgtaatcccagcactttgggaggccgaggcaggcagatcacctgaggtcaggagttcgggactagcctggccaacatagtgaagccttgtccttactaaaaatataaaaatcaggcgtggtggcaggtgcctgtagtcccagcta

SEQ ID NO: 13411 - DNA, 509 bp, Homo sapiens
atagtgttaaagtctgtatactcttctcatacacatagattcatgtttatattgatgaaaaagtatttctaataaaacttagcatttttgtgtttgaaaaatatgacttttaatgatagttagtgatttatcagtaatacaaatatccttctctcgtgtaattagtggagacaagtctcaagctgagaattgttaagtgtcagtgcttgcttaattggggcaattttcacttatttgaaaaatacatactaataccatttgttaaatgatcagaacttgctctcattgaaaaagaaaggtagaggccgggcgtggtggctcatgcctgtaatcccagcactttgggaggctgaggcgggtggatcacaaggtcaggagatcgagaccattctggctaacacggtgaaaccccgtctctactaaaaatacaaaaattagctaggcttggtggcaggcgcctgtagtcccagctgctggggaggctgaggcaggagaatggcatgaacccg

SEQ ID NO: 13412 - DNA, 384 bp, Homo sapiens
acgcctggctaatttttgtattgttagtagagacggggtttcactgtgttagccaggatggtctcaatctcctgacctcgtgatccacccacctcggcctcccaaagtgctgggattacggctggagccaccgcgcctggccgctaatttttgtagttttggtagagacagggtttcaccacgttgcccaggctggtctcaaacctctgagctcaattgatgcacccgcctcggcctcccaaagtgctgagattacagagacgtgagccaccatgcctggctgtaatcagttttaaaatagaaagaatttggggcaaaaacactttctagttgttgctcagcaaggtcaatgagtggtcggcacagaatagctcctgtcatctg

SEQ ID NO: 13413 - DNA, 200 bp, Homo sapiens
tcgctatctcccatacctgatctggggaaactcactgaggtgacatttaaaaagatgagggagtaggccgggcgcagtggctcatgcctgtaatcccatcactttgggaggccaaggtgggtggatcacctgaggtcagaagttcgagaccaccctgaccaatatggtgaaaccgtacctctactaaaaatacaaaaatt

SEQ ID NO: 13414 - DNA, 594 bp, Homo sapiens
ttctatgcagagttttccccattctctggaaattctcattttaggaaccttacttctgttccctgggaaccccagtcccatccctttaagcaatatgaaacaccctgtctgtggatcaaattccagggagacttctgggcaaaaattcttttgccccatgacctgatatctttggtcatgcctcctggaggcacaagtccccaccacagggccgcctaccacatgtatctgatggctgaaattaagggcagcagggcagaaagcggatctgctgacaccacagttagacaagcttgcaccaaggctgtaaaacacccttggcagagcacaccagtaagttgtcctactaattagtttattatttcatttgagagatcaaatacataaataaaattaataaaccctgcaaaatacgtgcagcactggaaataaaagtacttctcaggtcattgcattaaacacagatattacatgctagaataatgttaacgcaaggaaagcaaatcatgctgccttataggccggaacgtaccaggagcagctggggtttgtggagtggttgacaagctttgggataggtcaggaaacatgaat

SEQ ID NO: 13415 - DNA, 532 bp, Homo sapiens
gtggtccggggatggcagtgggaccctgcagaggagtggctctcttggcaagatccgggatgtgctccgcagaagcagtgaactcttggtgaggaagctccaggggactgagcctcggccctccagcagcaacatgaagcgagcagcctccttgaactatctgaaccaacctagtgcagcacccctccaggtctcccggggcctcagtgccagcaccatggacctctcttcaagcagctgacattcaacccggcccccaggtctgctgggtccccccacccccacagccctcacagcattccccattgctcctggctcttccccacccctaggtgggacagtgaaggggagcagtttaaccagaagattgctgctgcccttagggtctcagctccctcctcaggaatccctcttaggaaggaccctcaggacaccctctctgcaccctgtggtcctctagagtagctagctctgaggccccaaggtgggtacaaagcaggtatggccctcagagatgcagcctgctgctggc

SEQ ID NO: 13416 - DNA, 437 bp, Homo sapiens
gtctgggcttgtctagcagtggaattctgcctgagttcatcatttttgtgactggtacttgaagtgcatcagatgattaatttcatgataagagggctttttggggtggtgaaatagacatttatggaaaatgggatacccacattaagcagggtgactacctgtttaccatacaacccacacaaagccaatacaactatagatgtgctttatttagtctgttgcctctgcaaacattgcccgtgtgtttctctatgcccttcaaaaacatcagagcagcacatcctggaagatcctatcttttgtaagtttaagaagcagcctcttgtcacaggttgactcctaggtagtgtgcctagtgaccaagagggctgctaagaaagctttctgaccacttgtggctgtcattggactgatttgcccagatgacatcaatt

SEQ ID NO: 13417 - DNA, 197 bp, Homo sapiens
ggagcagaatagagctgcagtcagcagggagcagggctcattctggggagcagagacaaatagagaacagtatctcttgctatatgcagggcactgcaacttacaaatcacagcgcatggcgaggacgagggttggggtggtacctctcaccatgtctccagctgttccaacccgtggtcaatgggagctctgatgc

SEQ ID NO: 13418 - DNA, 300 bp, Homo sapiens
aatacctttaaatccctgggcagcaccgcagggacagatattaccgtcaacagtgtgattctacttcctaaaaaccctgagcactttgtggtgtgcaacagatcaaacacggtggtcatcatgaacatgcaggggcagattgtcagaagcttcagttctggtaaaagagaaggtggggactttgtttgctgtgccctctctccccgtggtgaatggatctactgtgtaggggaggactttgtgctctactgtttcagtacagtcactggcaaactggagagaactttgacagtgcacgag

SEQ ID NO: 13419 - DNA, 293 bp, Homo sapiens
ggccagccagctgctcacactggacaccacctctatccccctgcgcctctgccctgtcgcctcctgcccggacgcccgcctgctggccggctgcgagggcggctgctgctgctgggacgtgcggctggaccagccccaaaagaggagggtgtgtgaagtggaattcatcttctctgagggctccgaggcatctggacggagagtggatgggctggcatttgtgaatgaggacatcgtggcctccaaggggagcggcctggtcaccatctgcctgtggagctggaggcagacgt

SEQ ID NO: 13420 - DNA, 109 bp, Homo sapiens
ggcacgaggtggccagagtggagaggatgtgcagaaaggggcaggagatgaaggttggcagcagctggtcatgaaggtgttaacaaggggcctccactgggctgtgcgg

SEQ ID NO: 13421 - DNA, 561 bp, Homo sapiens
ggcacgagaatatatcacatcatgtaataagcctctcagagatgtagcattgagcagattaaggcctcatttatagaagaattccaccctggccatgtgggcctgaaactctggagggctttaacaatgtcttgaggtcattgtcatttaaagagatgactcagtggttttatttagtagaaataaatactaaataaataatctccacagattatccagaggggtaagttgaaggatgttgacagataactcagtaaattgcgtctcaaatattaataagtttattctatgccagcaccaaaaatatttcagagatgcttttaggcttctctcaagtatgtcgggaacagaaaaggattatagaaatatttatagtaggcataaacttgcacaaaagctcaaagtaccttaagcaagcttgttgcaattattcttttggagaactggattaagtaattatttcttgttgcctctgactatttaacctcctactaaactgcccattgtttaaatgtctcttatttagctctgtttttatcactccttaaatttaatattctc

SEQ ID NO: 13422 - DNA, 405 bp, Homo sapiens
agttacacaatagtgtgttccccattggtaggacagtctactactgagtcctcctggcatgagtcgagctgagattaggatagggtaatgacccttcagttttggggaagggaccagagctcggccagtgagaagcttccagctccgtctggccatatccaggctgctgagggtcctgggctctgtccttaaacctcatcactgacatgacccagcaaacctcctcaagaggaaaaagtccccttgggtcaaacacagcttgtgcagttctcggggacctcctcctgccatcctggggatgctgtggagaatggagatgcacagggggctttgtcctctcctctgccttttggagaaaatatttcactcaaggcaaacgcagcctgagggcagcacaggggaccc

SEQ ID NO: 13423 - DNA, 514 bp, Homo sapiens
ggcacgaggttggttgtcaactttgcattataccacccacttgtaatatctctgccttgaagaggaaaaaccaggaacatttcctagaatccccttcccgttatgatcccaagttaggatatgccagtgagaggtgctgttttagtcccttttgcctgctgtgacaaaatgacacagactgggtagcttataaacaacagaaatttatttcccacacttctggaggctggaaagtccaagatcagggtattggtagattctgtgtctggtgagggctcattttctgattcatcgatggcaccttctcaggggtcctcacatgcggaattgataacgcagatctctgggatctcttttataagggcactaatcccattcatgagggttctgccttcataatctaaccacctatcaaaggccccatttctagtaccgttaccttaggggttaggatttcaacatgacctctggggagatacattcagcccatagcaggtactcacaatagaataag

SEQ ID NO: 13424 - DNA, 295 bp, Homo sapiens
gcctcaggaggagctcaaagaggagcagacagccatggttcctccagccatccctcttcggcgctgcagatactgcctggtgctgcagcccctgagggctcggcactgccgtgagtgccgccgttgcgtccgccgctacgaccaccactgcccctggatggagaactgtgtgggagagcgcaaccacccactctttgtggtctacctggcgctgcagctggtggtgcttctgtggggcctgtacctggcatggtcaggcctccggttcttccagccctggggtctgtggttgtgg

SEQ ID NO: 13425 - DNA, 424 bp, Homo sapiens
cattgttacaagtaagcagctttattggttcttttacttacgtctttaaatatatggagcaacagtacggtcagtctgcatctcatgctaactttttgttgggaatcataaccattcctacggttgcaactggaatgtttttaggaggatttatcattaaaaaattcaaattgtctttagttggaattgccaaattttcatttcttacttcgatgatatccttcttgtttcaacttctatatttccctctaatctgcgaaagcaaatcagttgccggcctaaccttgacctatgatggaaataattcagtggcatctcatgtagatgtaccactttcttattgcaactcagagtgcaattgtgatgaaagtcagtgggaaccagtctgtgggaacaatggaataacttacctgtcaccttgtct

SEQ ID NO: 13426 - DNA, 605 bp, Homo sapiens
ggtgggttatacctgtcttgcagccatccgagatcacgcttctgtcttgtctttctcgagaagcaggtggaaacatgagcattcagtttcttggtacagtgtacaaggtgaatatcttaaccagacttgccgcagaatttaacaaatttatgctggaaaaagtgactgaggacacaagcagtgttctgcgttccccgatgcccggagtggtggtggccgtctctgtcaagcctggagacgcggtagcagaaggtcaagaaatttgtgtgattgaagccatgaaaatgcagaatagtatgacagctgggaaaactggcacggtgaaatctgtgcactgtcaagctggagacacagttggagaaggggatctgctcgtggagctggaatgaaggatttataacctttcagtcatcacccaatttaattagccatttgcatgatgctttcacacacaattgattcaagcattatacaggaacacccctgtgcagctacgtttacgtcgtcatttattccacagagtcaagaccaatattctgccaaaaaatcaccaatggaaattttcattgatataaatacttgtacatatgatttgtacttctgct

SEQ ID NO: 13427 - DNA, 486 bp, Homo sapiens
gtggaaacatgttgccaagtcagatcgccattctacttgagtgaatatggaatttgtccagttttccaaatgcagagctttttgtgggctgatggactgaatagaaagaggaacaaccatacacccttctacagatgaaggcaagattttatgaaagcgacttcattcgttctcctctgcctggtgttccttctttgtaaaccaggaccagggagctttgaatatagcagtatattatagaatttggtttcattaaatattatacctgcccttagtgtttatattccagtatattgacaacccaggtcctctctgtacctgtgattgtctgtgttgagactattacagagctccaaaaattaaaataaaaataataattttacagaaatacatatttgcattggaatatttaagaaagttgagtttggatgccacaagattataggagtaataggaagctgggcacagtggctcacacctgtaatc

SEQ ID NO: 13428 - DNA, 534 bp, Homo sapiens
gcctcatttaaccagcactgacagcacatgggcgtttcacagaatttaacttaccaaatagcctaaagttatctttccttataaagttaaaacattttcatgggcagtttttcaaaatgtatgcaattcttccttgcttttttgcatgtagcaggcattgcttgattaaactttatgttggatgacttaaccttttcataatgactcaatgtcatcattacaaaaattaattattactctgggttataatacagtattgttctcaggagtttttgaggtttggaaagatatttatcttactaaaagctctagagtgctatgattcttcttattagaaggatgagggtaaagaaggggtctaaactgaatactcagttcccatggctctgattttagaggtcattatgtaattctcagacacctaagttttgaggctatccctggaagaaactaccctaaagtgggagagaacagaaagatctctttgagcacagaggacatctactgaagcccaaataattttatactatcagc

SEQ ID NO: 13429 - DNA, 309 bp, Homo sapiens
caaccttgacaaatagaattataggagcttacatgttctgattgatagatgagcagactttacaataaaaattataaaaggtagatagatattttatgcttgcattagaaaatatgtaggccaaccaggcagtggctcatgcctgtaatcccaacactttgggaggccaaggtgggcggatcacttgaggttgggagttcaagaccagcctggccaaattggtgaaaccccatctctactaaaaatacaaacattagccgggcatggtgacagccgcctgtagtcccagctactcgggaggctgaggca

SEQ ID NO: 13430 - DNA, 410 bp, Homo sapiens
ggcacgagctctgattccttcaacgaggacatcgctgcctttgccaagcaggttcgctctgagaggcccctcttctcctccaacccagaactggacaatctgatgatccaggccatccaggtgctgcggttccacctgctggagctggagaaggtccacgacctgtgcgacaacttctgtcaccgctacatcacctgcctcaagggaaagatgcccatcgacctggtcatcgaggatcgggacggcggctgcagggaggacttcgaggactacccagcctcctgccccagcctcccagaccagaataatatgtggattcgagaccatgaggatagtgggtctgtacatttggggaccccaggtccatccagtgggggcctggcctcccagagaggggacaactccagtga

SEQ ID NO: 13431 - DNA, 458 bp, Homo sapiens
ggcacgaggcaaagcctcgcggcgaggaaagcacgagtattcaagcgcggctgaggccctccttggctagtgctgggacatggagccccggcagccaaggccaaccttgtgcattccgcccacgtaggcgcctggggccctggtcttcctcgactgcctctccactgcctggaggtcatcaaatgcccctggaccacctcctacgtgccacacgctgtgttggccatccaaggttccatattgagcataaaacagccctctgccctaaaggagttaacctgttggaatcacatacaaaggattctgactaccaagcgccttgaagttaagttgaactctgaagacagattgcctggctacaaagctcagttccactacatatggtccaggaacttaagacaaattattttaatgtctttatgtttcactatccgctgtagtgaaatagaataatacct

SEQ ID NO: 13432 - DNA, 459 bp, Homo sapiens
ctccccaatgaggaccccctctggacgccccttcccatggagaacaccaggagccacagaccccagaccacagagcacacaggggagggcacggggcggccggggcagggtgtctgctgcctcgtttatgggatttgctccgcgtctagcacactgctgcctgcagtgctcctgtcccctgcagtggctactctgggcctacgggcctaatcctggttggcatgaaaatgtcctgaggctactgtgacaaatttccacaagctgagtggcttaaaggaacacatttgttctcttacagttgcaggggccataagagtctaaaaacagtcagcagggctggttcctcctggaggcttagaggggctgaatccgtttcctgccttttttagtatctggagggcgcctgcatacccttgcttatggccccttccatcaccaaagccagtagtgtcacatctt

SEQ ID NO: 13433 - DNA, 337 bp, Homo sapiens
agcgcctctgcccggctgttttttctgggaggtgaggagcgcctctgcccggccaccaccccatctgggaggcgaggagcgcctctgcccggccgccaccccatctgggatgtgaggagcgcctctgccagccgccccgtctgagaagtgaggagagcctttgcccggccgccaccccgtctgggatgtgagaagcgcctttgcccagccgccacgactgggaagtgaggagcgcctctgcccagccgccaccccatctgggaggtgaggagcgcctctgcccggccgccccgtctgggaggtggggagcacctctgcctggccgcccatcatctgg

SEQ ID NO: 13434 - DNA, 462 bp, Homo sapiens
atagttaattgtagttaaaagtacgagataaaaaagaaacaattcggtatacggagcatattaagtgagatacggacagaaagagggacacaacagaagcaggtaagagctgctgccctgtctgtatccatgactgtggtgaacttgcccaccagaagaatatgaaaaagcagagtgacttggttaaggggaaagcaccaagatgatgggctttctgttgcctcctgcaagcagagggacttggagaccattcagcagaagcagaaaaaggcaaatgagaaggagaacccaggccgggcatggtggctcacgcctgtaatcccagcactttgggagggcgaggcaagtggattacctgaggtcaggagttcaagaccagcctggccaacatggcaaaacctcatctctactaaaaatacaaaaaaaaattagccaggtatggtggcacacgcctgtaatccc

SEQ ID NO: 13435 - DNA, 608 bp, Homo sapiens
ggcttcttgggtaccagattcccacttagcaatctgccaaatagtcttctttctcggatgcaggtgatgccaagatccagtcccaagcagagagacctaaagctggcttttaattataaggcccatgatggtttgttgtgacttagactataagcattctgagacaggttccaagacctggggaaatcatcattaaacaaacaaagaggcaagacttgtgcaggactcatatcagaggacataaggagggagaagaagggatgagaatctttcctaaataatgcactgcttcttcaagacccatgcctgagacaaacaggattattaagttgggaaactagcctgtttcacctctctctaattagaactccctacacctcccaaacaagagaagggaaagcaactctgttttctgtccatgtctgcccagccagggaaagaatattaagtctcagagcaagggtcgggcacggtggctcacgcctgtaatcccagcactttgggaggccaaggcaggcagacgatctgaggtcaggagtttgagaccagcctgatcctaaaaatacaaaaattagccaggcatggtagcaggcgcctgtaatctcagc

SEQ ID NO: 13436 - DNA, 510 bp, Homo sapiens
taatatctggcatataataagcactatatacatgttacctactggctagaattcatttgattctcacagcaaccttatgaggtagggtactatcattatatctacctgttttacagatttggaaactgaacaagcagaaggcagccaaagaggcagagagggcaaattctgagacaagttctttcccctgcccgggttccagttctgaacaggaacatgggtctggcctatactggacacggactaaggctgggggaagcatagatagtctgacccaccagatctcactgtgtcattctcctccaagctctgggcccctggccccaagtagcacttgggtgctgctccaggggacaggtgaagggccactagtgggaaaacatgcatctaaaagtcaggagatctgggactgagtcccaactcggctactaactagccctgtgatttcaggaataggtcagtcactcattttgaaaatatttgttgagcacctactatgtgccaggcatt

SEQ ID NO: 13437 - DNA, 468 bp, Homo sapiens
ggtattatctactaaagatgaatcaagagtgcaaaataaccaaaatcaaattcaccagccccagctaagtgaaggttattcagtacttttagaataactgacacagaggcagtgattcatcttgtcttccccacccgcctgtttttgagatggggcctcactgcagtagctcaggctcgagtgcagtggtgtgatctcggctgaggctcgagtgcagtggtgtgatctcggctcactgcaacctctacctgccaggctcaggcgatcctcctgcctcagcctcccgagtagctgggactacaggcgcacaccactatgcccagctactttttttgtctttttttagtagagacagggtttcgccatgttacccaggctggtctcgaactcctgaacttgagcaatcctcccacctcatcttcctgaagtgctgggattataggccagccttttttttttttttttttt

SEQ ID NO: 13438 - DNA, 498 bp, Homo sapiens
actcgccgacatctcacgtctcttggctttgccagggcccaccggagaaaactgacgacccgtttctgtaatccttatgggagaccaaccttgtgcctccgggagatccactctcccacctggaaacgcacgggaagccaagcctccaaaaaagcgctgcctcctcgctccgcgttgggattatccggaaggaactcccaacggaggtagtaccactctaccctccgcacctcctcctgcatcagccggcctgaagtcgcaccctcctcctccggagaagtagagaaataaatttctcccaccctaaaccagtctttgagtgattgcagtatgactccatttccctggtgcattcatataatagttcacctggtgaaaacaatgaagattatttacaatgctaccctgctttttctggtgtcctgaacctggaagttgtgctttttaagtcttatgatgtaatcagcgcgatttcacttcctgaatttcgatgaattc

SEQ ID NO: 13439 - DNA, 522 bp, Homo sapiens
ggactcaagatgactttctaaggtgatttggggatgcagtgtatgcatttttttactctttttgaaaaaaatcttttcttcgcctttggagtgtaacatttggatagttttattcagcccataataggaccaaagggaaggggataaaaaaaaattctttaaagtacctcagataaaaaggttttgtgaagaaaaggactcaaaatcctaggttataccaagactttatgttcattttgaattttctttattcatttttttcctctctgtgtatagaataatcaggagatattggtgggcagaactgttggttgataacaggaagcagagtatctgagaaaggccctcatcctgtttccttttggagctactgaggcctcacatgccagccattttaggatttgatgaaagctagagaagagttaaactgagccttcacttactcagcatcagtaggaagtagtgttggctacactaaaaacaccgttgtgccagtgaggatttggggggaaaatgacaagc

SEQ ID NO: 13440 - DNA, 493 bp, Homo sapiens
ggcacgaggctggccaaagccaaatctcctaagtccaccgcccaggagggaaccctgaagcctgaaggagttacggaggccaaacatccagctgcagttcgcctccaagaaggggtccatggccctagtcgagtccatgtgggctctggggaccatgactattgtgtccggagcaggacccccccaaaaaagatgcctgccctagtcattccagaggtgggctcccgatggaatgtcaagcgccatcaggacatcaccatcaaacctgtcttgtccttgggcccagctgcccctccgcccccatgcatagctgcctcccgggagccgcttgatcacaggactagcagtgagcaggcagatccctcagcaccctgccttgccccatccagcttgctgtcccctgaggcctcaccctgccggaatgacatgaacactaggactccccctgaaccctcagccaagcagcggtcaatgcgctgttaccgaaaagcct

SEQ ID NO: 13441 - DNA, 565 bp, Homo sapiens
cgcattaactttcagtttccccatgttacttttgtaacagggatttgagaccttaaactgttcatcaaagtaagccctaatagaaaggcagagcaataagagcacatgctgatgtaattctcctttgcaaggagaatttcatttagttccattgtcatatagaccagtgtcaccccttttccctgattcctactgttaacaactatttttcagtgcctttgaagatactgacccttctacctgcccagctgtttttaaacagctggagcgtgatgatggtcataaaatatataagtgttttagcatgtacagtaaaactaggttgtttagttaaacatagagttttgcctactttttcaattcgtttgactgcaggtgtggtcatttagttgcaaaccatttccatagtctgcttccactgtccagttaatctgtttttttccccttctatcatctgagcattcatctgtcatttccttcttttttatttatttatttatttatttatttatttattttggagatggagtctcactctgtcgttcaggctggagtgcagtggtgc

SEQ ID NO: 13442 - DNA, 506 bp, Homo sapiens
tacggctccgagaagacgacagaagggttacattaaacatatgatttatgaagagagtggtatagactaggagccaatatagttttaataaaaataagtcatgctaaaacaatctaatttctctttttgattctattggaggaatatgggcaagtgaatgatctagtctcagaggagcctgacaaagcctctcaaggcatctttacgttaagggtaaaatgatggctctctgaatacacagactgcatattacttttcttaatttacccccctcgtgccaggtacacagcagatgcttaaagaatgtgttggccacgcgcagtggctcacacctgtaatcccagcactttgggaggtcgaggcgggtggatcacgaggtcaggagttcaagaccaacctgaccaacatggtaaaaccccatctctactaaaaatacaaaaattagccagggggtgttggcacacgtctgtaatccccgctactcaggaggctgaggcaggagaact

SEQ ID NO: 13443 - DNA, 631 bp, Homo sapiens
tcacaggtccgtgtgccagatacgacacacacacatacacacaaagaaagacacgcacacacacacgcacacgcacacatgagcacgcacacggacgcgcgcgcgcacacacacacacacacacacacaccattaagtaaacttggttcttaggcgttaccgacagtgagggatagagagagaaatagaaagacctaagccgcaaggcaaaacccagcaagggcagcagaagagatcaaagtcctgtgcccttggctgtcagcagagtgggtgctgggaagcttctggaagcaggcacctgagtggatgccggtgcacgtgaaaagaggccttcaagcctgaagaacacgtaaggagccagaacagggtgccacagagatactacccttaaggaagacagaaaagcattcgttccggggaaggggacattatccaatcagcgaccctgtgaaactcagacatgtccgggcacggtgactcacgcctctattcccatcgctttgggaggtcgaggccggcggaccccctgacgtctggagttgcagaccagcctgaccaacatgaggaaatcccgtctcttctaaaaagacgaaactcggttgggcttgctggcgagcgcctgtaatcccag

SEQ ID NO: 13444 - DNA, 481 bp, Homo sapiens
cacgccattctcctgtctcagcctcctgagtagctgggactacaggcgcccgccaccatgcccagctaatttttttgtatttttagtagagacgggttttcaccgtgttagccaggatggtctcgatctcctgacctcgtgatctgcccgccttggcctcccaaagtgctgggattacaggcatgagccaccgcgcctggcccattttcttcctcttttgaggtaatggatttgtttggagatggcatgttagtagacgactgaatatggaaaggatatcgagttatctattttgttaattttatttttgttttttatcatctagatttttatcatggattagtctgaaatttaaagttctggccagtcggttttctttcatcttgtagtttttacagtatttccactgtgcatatgcaaaatgggtattacataactgtatcatatttggtattgataattttttttttttttgaaacgg

SEQ ID NO: 13445 - DNA, 129 bp, Homo sapiens
ggcgtttgtttctacatcacatgtttctttaatgatttctccctcccttaacttcttccccccaaaaaaattacctttgtattaagagtaacaaagccagccgggcatggtggctcacgcctgtaatcc

SEQ ID NO: 13446 - DNA, 631 bp, Homo sapiens
gaattgagaatataaaagtgggtacatgttgttccaaattagtgggaaatttatattgtaggctctaggtgcattttgctttagaatgagactcatcaataatatagaagacattccatagtataagagaacaagtactgtgacagattctcctaataacataaatttgattttttactgattttaaaattaaatacattaatatatcactaaaatagctagagatatgtaatttctaaaagtaaagcatactattattaatataaatattgaatatgtataattgttgtctggtaaaaattaaaaatacagtaataagtacataatacatataaaaataaattctatggccgggcgtggtggctcatgcctgtaatcccagcattttgggtggccaaggtgggcagatcacctgaggtcaggagtgcgagaccaacctgactaacatggtgaaaccccgtttctactaaaaatacaaaaaattagccaggcatggtggcacatgcctgtaataccatctacttgggaggctgaggtacgagaatcgcttgaacctgggaggcggaggttgcagtgagctgagatcacgccattgcactccagcttgggcaacaagagtgaaactctatct

SEQ ID NO: 13447 - DNA, 591 bp, Homo sapiens
accacagctagaccagtgggtgccacaatcactgtgtcaactatggaaagggcagctgagatcacatcaaagattccggaaagaattggcacaggatcattcgggatccatctgtcccttgcccctgttcctggctttccttacagctctcgacttcctcaaaggagtcatcaattcggggtttggcttccattcctattgaggaagctggaaagcgtttcaaaaatgctcctccgatgtgcctgtggttaagacctctgagctctgttgaaaacttttggaagctgggagcggtggctcacacgtgtaatcccagccctttgggaggctgaggcaggcaaatcacaaggtcaggtgttcgagaccagcctggccaacatggtgaaaccccgtctctcctaaaaagagaaaaaaatgagcctggcgtagtggcgggcgcctgtaatctcagctactcagcaggctgaggcaagagaacagctggaacctgggatgcggaggttgcagtgagccgagatcactccactgcactccagtctgggcaacagaatgagactccgtctgaaaaaaaaaaaaaaaaaaaaaaaaaaa

SEQ ID NO: 13448 - DNA, 648 bp, Homo sapiens
acttgacaaatgaagatagggacctctttcattataagcctattttaggctaaaatagaagggaaggggacacagtgaatccaggccttctggcatggctcctcagccctttctgagctggcctgggacagccttcctacctcactgatgccacttcctactgagcgactttcctgcctacctcactgatgccacttcctactgagcgactttcctgggctccagacccagtaagcgactttgcctgcacccaccttattttgctctactccctgtgcttttatgcctttacccatctgccctggaaagctcttctaacctttgaatgggtaaaggcataaatgtatgctggagaaatcctcagctcagggccaggcacgctggctcacgcctgtaatcccagcactttgggaggccgaggtgggtagatcacctgaggtcgggagttggagaccagcctgaccaacatggagaaacccctgtctctactaaaaatacaaaattagctgggcgtgatggcacatgcctgtaatcccacagctactcgggaggctgaggcaggagaattgcttgaacctgggaggcggaggttgcagtgagccaagattgcgcctctgcactccagcctgggcgacagagctagactct

SEQ ID NO: 13449 - DNA, 521 bp, Homo sapiens
atccttacctgtcagctctgtcttcatcttcaaaagatttagaaacaatagttactcttaagaagactatcagaatctcaccacacagggagagtgaccattctagtctaaataacaaatatttgaatggatgtggagaaatatcagtttcagaaatgaatgaaaagttcacaactctgtgttataggaagtataatgatgtctctgatctttgcaaattagaaaataaacaatattgtaggtggtccaagaaccaagatgacagttttacaatttgcaggaaacttacatatcctttagaaactctttgcaatagtccaaatagaagtacaaatacattgaaagaaatgccttggggacatatcaataacaacgtaacacagagctattctattggttatgaaggtagctatgatgcctctgctgatctctttgatgatattgctaaagaaatggacattgcaactgagattaccaaaaaatcacaggatattttgttaaaatggggaacatctttggca

SEQ ID NO: 13450 - DNA, 358 bp, Homo sapiens
aaagtgattgtatatatcactttttatcctaggtcaggataagcaagcagtacataaatttttaaaacaggtattttaggtagtgatacatgctataaaaattacatggatagagaatgaccaaagatgactagattgaatttaccacttctttgagtaggtggcagtggttcaagttggtgactgagttctaaacgatgggaaaaagacagccctgcagtggtatgtgggaagtgttctgggcagaaaacatgttctgaagctggaacaagcttggtactttaaagaaaagaggctgggcgcagtggctcacgcctgtagtcccagcactttgggaggctgaggagggcagatcatg

SEQ ID NO: 13451 - DNA, 328 bp, Homo sapiens
ggcacgaaaaaagtctcccaccttttctcctaaaacttctctcctttctctccataaaaagaaaaggaaaggaacaaaagaaaaacattcagtttttctttttctgaaaaagtaagtcctttcctgaagtcatcaaatgaaacattatctggaaattagtttctaatgttgtatatgaagaaatacttaaatataagttcctgcagtatttattagatagttgtaactgtaaactcacctccctagtagataagagtttcaggttaaatactggaacatatataggcagtcaaaaatactactttaaatgtcattcacctattttaaa

SEQ ID NO: 13452 - DNA, 300 bp, Homo sapiens
gccgccactcgtatcccccggccctgggcagccctggagctctagccggggccggagtgggagcggcggggcccttggagagacggggggcgcaacccggacgacactctgtgaccggctacggggactgcgccgtgggcgcccggtaccaggacgagctaacagctttgcttcgcctgacggtgggcaccggtgggcgagaagccggagcccgcggagaaccctcggggattgagccgtcgggtctgcaggagccaccaggtcctttcgttccggaggccgcccgggcccggatgcggg

SEQ ID NO: 13453 - DNA, 484 bp, Homo sapiens
ggcacgaggggttctttaacctgtgcttcctctgtcctacttcccatcctgcacagttcatagagtcactttctgactatcctatagacacagtaattggacctgtgtttttttctaatctttatatgacagcacatttcctaattcagggaccatcccctatcccaaattccatcctgtgagatgtgaaacctgtgagttcatgtgaatgagtgtttgaagggcttgacgccatgtagtctcttaggaaggcttcagggtgctcttatgttgatgctttgccattatcaaatggcattgattgatccgagggactcagaaagttagggtagactctataaataatttcattattcctcatcctctccgtcatcattttattggttagtcattctgccagatcactaagattcttcctctacaggccccgcaaaattccacagagccctgattctccacctgcagatggagtctccctatccca

SEQ ID NO: 13454 - DNA, 340 bp, Homo sapiens
ctaaaaagctcatctaaaagccaggctctaatgccaattcaagagcctgggactcaatgtgagctcagccagaatcttcagaatctctatggtaccccagtattcaggcctgttctagagaactcctggctctttccaaccagaattggaggtaactttaaccatgtttccttgaaagcctcctgggttatgggccgcccctttgggtcagagcagaggcctaagtggttccatcctttgccttttcagaatgcaggggcccagggccgaggtaaaagttttggtattcaatccttccatccccagatattttattcaggtgaaagattcatgaaatttt

SEQ ID NO: 13455 - DNA, 399 bp, Homo sapiens
agccttattaactatcttttcattatgagacaaaggttctgattatgcctactggttgaaattttttaatctagtcaagaaggaaaatttgatgaggaaggaaggaatggatatcttcagaagggcttcgcctaagctggaacatggatagattccattctaacataaagatctttaagttcaaatatagatgagttgactggtagatttggtggtagttgctttctcgggatataagaagcaaaatcaactgctacaagtaaagaggggatggggaaggtgttgcacatttaaagagagaaagtgtgaaaaagcctaattgtgggaatgcacaggtttcaccagatcagatgatgtctggttattctgtaaattatagttcttatcccagaaattact

SEQ ID NO: 13456 - DNA, 53 bp, Homo sapiens
gcctttgtctggaaggtgctcggtagccccgtctctcctgcctggctgaactc

SEQ ID NO: 13457 - DNA, 276 bp, Homo sapiens
taggggcgggaagcattgaagctggtttctggccctagcgctcccctgcgatgagatgtgggagccagtgtgtccctgcctgtccatcctgtgcacccccagctttccttgtcacctgaaaccacctctgagggaaggtggtggcgtctcagatgcatgggcatgtggctggtcaggtggcctccatcccagggtgccccgtctgtgtgacctccctctgggtgctgtgggcttgctccagggtgcaggtgcaaccccagcagcggtctctggggc

SEQ ID NO: 13458 - DNA, 276 bp, Homo sapiens
tggggtgccggctggtcagcaggtcacctgccaccgaggcccttcacctgcagatgggctccatcgcctgtggcctcgctggttaggctaaagggcagcccgggctcctgcgggttggagagctcatagcaggaatgtctgggcccaaccagttctcacaggctcctcaggagacagagcctggacttcgtgtcttagcctcatacttcaggattaggggggcatttgtttaagggtgtataagctctaattgtttttttttttttttggaaaggg

SEQ ID NO: 13459 - DNA, 159 bp, Homo sapiens
ctgggtgacagcgagactctatctcaaaaaaaaaacaaatttctctcctatgaaagtttctggtctttgatgctgcactttcctcttctgaaacatcaagtgcttttaaaaagggatggggctgactgcctggttctgaggcatgaacgacactggtag

SEQ ID NO: 13460 - DNA, 503 bp, Homo sapiens
agcactttgggaggctgaggcagatggatcgcctgaggttgggagttcgagaccagcctggccagcatggtgaaaccctgtctctactaaaaatacaaaaattagccaggtgtggtggcgcacacctgtagtcccagctactcgggaggctgaggcaggagaattggttgaacccaggaggcggaggttgcagtgagcagagatcgtgccactgcactccagcctgggtggacagagcaagactccgtctcaaagaaacaaacaaaaaattaaaagggatagaatataatgaaatatattttgaacttaaattatattctatatgtgtatcttcctaggcaaaagctgtaatttccagagagaccattaggaacaggtagtatctatttttctccattatttatttctagaaactcataaaatggattgtatttttctataagaacaaaatattaattaaggtatagatgactgaccaagggcttaatcaaataaaatgacta

SEQ ID NO: 13461 - DNA, 429 bp, Homo sapiens
aaataacctataaataatggcaaaaaaaaagcaaacaataggaagaggaactatataaaaggaacatttggagcatagaagagagttcatggaaatgtaaaaaatgatggtaccctgggtttgatatagtaagtaaaaaactaagggtaagagggtcatgaaagcatctagaagtaggagggaaagccagtcaaattcacaggatgaagtcaggaagataatagagcagtgcccgcaagatcctgagggaaagcaagttccaatctataagtctgtaaccctcacacctgatggccccttgaacatattcagggcttcaaaagattgatctgtcatgcaccgtctgccatgatactgtgtgaggatgtgttcttcttcttaaacattaaatcaagaaagaatcaacagtggacccagtaaatagcagat

SEQ ID NO: 13462 - DNA, 504 bp, Homo sapiens
tatagaactaaaatgtcttaaaccacgcttagtttcatatttagaacaaaaaaatccctaaaccattctgtttaactgttagaaaccattctgtaaaatgaagaaaatgggagacatggaaactgattgggggagttaagctttactctcatttttctcagccattaagaagctggaagtatgtttctttaaagaagaaaaattcacagtgtgccatcttatttctcttttctgccactttttaaaaatcttcttattcagaagttcagcaaagtaaaccaagtctggcctaatactttgatttacttgaatacctctacgtatcttaataattcctttaattttacattgtgtaaatatttatgctctggaggtgatatttcttttagtggtcaggaagtacctcttgtagtacacagacactcaagattttgttacctgagcacatactgtagggataactgggttaatgtgctttattatgctttaaagctatacctacta

SEQ ID NO: 13463 - DNA, 575 bp, Homo sapiens
ggcacgagagaaactacttctatgatttcagctggagtctgaagatacttgtttctgttcaagtcccactttaaattatgtcttaggagactgaaagtggaatcttctgagcattcctaaatatctgcttagaaatatcatgtgataaagagggaccttcttaatacactgatgttcttcactaaatggatggccacaagaaaaataaagtaaatgtcttaaataatttaaccataaattttctgtcatgtgatactggaatatgggatacttttcatgtttatatatatatatatatatgtatatatatatacatatatatatatatataaacatgaaatatatatatatggctcctttgtgccccatgtcattttcagattatggtagcatgctgatacagcaccatgaaagaactcaaggaaaatatatcaatgtaagaagttcactcttagacccagtgttctgaggtcacatgggtttggactgtctcaatcagaaagattaatgactgttatcaagaacatgaacattggcttcctccatagagaagaaatcagtatctgagttgcata

SEQ ID NO: 13464 - DNA, 410 bp, Homo sapiens
  misc_feature 254: n = A,T,C or G
atcttataactaatcttattctgtgtaactaaacaataggttaggtgtctgtcacagcatttcaactgaaataagactgaacctatcctaaacccctcacttgaaatgcccggtcttctatgtattcaaactctattcaaagtccatttcaagttctatgttttacataacaccatctttgaatttcaagaggatttatacagcatagccctacgtttggtgctatcactacttattttttttgagacagggtnctcagtctgtcacttcaggctggagtgcagtggtgccaccttggctcactacaacctctgcttcccaggttcgagcaattctcccacctcagcctcccaagtagctgggattacaggcatgtgacactacacccagccaacttttatatttttagt

SEQ ID NO: 13465 - DNA, 184 bp, Homo sapiens
gaggcggaggctgcagtaagctgagatcatgccattgcacaccaacctgggcaacgcagtgagactccatctcaaataaataaataaaatagcacatgtatcccacaaataattattaagtatcaatttttaaaagcagagatgtaaagataaatgattcttctaaaaaagtataataaatctt

SEQ ID NO: 13466 - DNA, 383 bp, Homo sapiens
ctggttttgaactcctgacctaaagtgatctaccaccttcagcctcccaaagtgctgggattataggtgtgagccaccacactttgccaataagatatatttcatatggcatctaaccacaaatattccgaaggtttcagaaaggaactgaaaggaagaaatgggctggataggagtataggatggggagaagatcagacaagccctaataatccattacgccattcatagtaagaaaatagcaagaaaggccgggtgtggtggctcatgcccgtaatcccagcactttgagaggctgaggcaggcagatcacttgaggtcaggagttcaagatcagcctggccaacatggtggaatcccgtctctactaaaaatacaaaaat

SEQ ID NO: 13467 - DNA, 568 bp, Homo sapiens
gaatctcgtggtgcgccgttttttaagcccgtcggaaaagcgcagtattcgggtgggagtgacccgattttccaggtgccgtccatcacccctttttttgactcggaaagggaactccctgaccccttatgcttcccaagtgaggcaatgcctcgccctgcttcgtctcgcgcacggtgcgcgctcccactgacctgcgcccactgtctggcactccctagtgagatgaacccggtacctcagatggaaatgcagaaatcactgtcttctgcgtcgctcacgctgggagctgtataccggagctgttcctattcggccatcttggctcccaagatataaggtatttaattcgactttttttggtagcaaaacgtgaaaaatctgaaattatatcaatgggggactggttaaacacattatgataaacccatatgataaaataacatgtagctcttaaaaggaatacgtataatctctgtagattgatctgaaggaatgtcaataatatattaagagagaaagagcaagttacagaaaaatgtttaatattattccattttaataaaca

SEQ ID NO: 13468 - DNA, 374 bp, Homo sapiens
tatagtgttgaggggcagatggggtatggatagatgttgagaatggcgtgaaggagtccttatgggactctagttcccctgctccctccaagaccactcagacccttggataagtcaccaatagctagaaataacacgagtttacttgaaatgtgtcttccagaggcagagcatgattaattgtcaagattttcctgttcttggcttagactgagttagcaaagaccctgtggatgtagaaatcacattgaaaaaccttcctaaaagtatgccctctttataagaacggcacgatggactctgaggactcaggggaacgggtgcgaggtgggtgagggaaaagagactacgcactgggtacagcatacatgctc

SEQ ID NO: 13469 - DNA, 447 bp, Homo sapiens
  misc_feature 224: n = A,T,C or G
gcgatttctacctgcgctactacgtagggcacaagggcaagtttgggcacgagtttctggagttcgaatttcggccggacggaaagcttagatatgccaacaacagcaattacaaaaatgatgtgatgatcagaaaagaggcttatgtgcacaagagtgtaatggaagaactgaagagaattattgatgacagtgaaattacaaaagaagatgatgctttgtgngcctccctgatagggttggccgacaggagcttgaaattgtaattggagatgagcacatatcttttaccacatcaaaaataggttctcttattgatgtaaatcagtcaaaggatcctgaaggccttcgagtattttactatttggtacaagacttgaaatgtttagttttcagtcttattggattacacttcaagattaaaccaatttaaattgtatgttttca

SEQ ID NO: 13470 - DNA, 406 bp, Homo sapiens
  misc_feature 117: n = A,T,C or G
aattcggcacgagaggcagtgactgccttcggctttttttctgctgactaagatctcctatagagagctacaacaatgcccaaaagaaaggctgcaggtcaaggtgatatgaggcangagccaaagagaagatctgccaggttgtctgctatgcttgtgccagttacaccagaagtgaagcctaaaagaacatcaagttcaaggaaaatgaagacaaaaagtgatatgatggaagaaaacatagatacaagtgcccaagcagttgctgaaaccaagcaagaagcagttgttgaagaagactacaatgaaaatgctaaaaatggagaagccaaaattacagaggcaccagcttctgaaaaagaaattgtggaagtaaaagaagaaaatattgaagatgccacagaaa

SEQ ID NO: 13471 - DNA, 227 bp, Homo sapiens
ggcacgaccaaagctgttttataaattagggagaagagtgaggagagaggaataggatagacgaaggtagagagagggagcagtggagaagaaaacctcagagtgaggcaaaggaagaggtgtgaaggggaaaagaagtggcgatggcagggaagagcccctggccatgagagagattgtttggagtgggaaggaagggaagttatggggcagggggcacagagcag

SEQ ID NO: 13472 - DNA, 462 bp, Homo sapiens
ggcacgaggaatggagttccacctgggctgttttattaactatttgcccctccgtttcttcatctgtaaaacagaaatgataaccttactattaattgtgtgaccttggacaagttacaacatctccctgggcgcgattgtcccatctgaaggtcataatagcacctgccacagaggatggtagtaaggattaaattagttaatccatgtaaattacctaggtaagtgcctgccatatagcaagtgcttggtacttttttttaaaaatcactggtatgactattgcagacacctttgccatgattggaatagctggaatccaaactcaagccttccatttccagggttctggctggtgtggggctgacagacctggatggggattcccagctctgcctctcttcagctgagcaagtcactggaacctctctgagctgcattctgttcagctgtaaaataata

SEQ ID NO: 13473 - DNA, 391 bp, Homo sapiens
caacaattcctgccaacacaggaacccacacagtgatgtggaaaaaaacttccaaatactcagtggtagccacacttaccacatcccgatataaggtccaccatatgcacacacaattgcagaaatctgtcctcgtttctgcactataaataaaaatcctgaaggaaatccagcccacccagacattagatgggaatcacaacaaccaaagcccctggtaaaaagtcacttcaaagttgaatccactgcatacgcagcagccttgtgacacagttataaactcttccctactacaagctcatagggcgtcccattaccctgtggacccattaccctggggacccaacaaaaggagatctgtacctcctgaaaccagtttataaaaaattaa

SEQ ID NO: 13474 - DNA, 378 bp, Homo sapiens
tgaaattgaaggttgaatatccaacatcccccacactgccccagtgtctctgctcccttactgagccttactattattcttcatagccctatcactacctagtctagtattcactgaactgtgtcatccactagaatatgagcataatgagagcagagactacacctgtcggttcagtattctatcctcagcacatagaatggtacctggcacatagcagatgctaaaataaaatttaaatgaataaattaattcaatcaacaccttcaaggtgttattattacctacaactattgtttacaagaggtatgcaccgtggaagatcctggagacacaacaatgaataaagccaagccagttcctgcccccgtggagctt

SEQ ID NO: 13475 - DNA, 389 bp, Homo sapiens
ccacattaaaaagaaaacaaaacaaaccctaactaacttccaaatgggtctcctggtgcgggggcgtgagtggccgagccctgtgtgtgctgcctgtctgagcaagcttccctagctgtggaaccccgggccccctgctgcgggctctgccttggtgtcatgcctgctgcacccccgtttccactgacgtgccgtctgtggctatggggtggtcactggaatgacggtcactccagacgtcagccggcagggatgcagcaggctggccgcgcaccggggctcgggcaccctctggccccacactggcaatgatgccacaccttgccatgtccacgctgttggtcaaacccctctgtcatgcctctttaaagagaaaagaagagaaagat

SEQ ID NO: 13476 - DNA, 135 bp, Homo sapiens
gccgtacgggagcagtcactctccgcgacacggcggcagcttcccggggggccggttcgggtctccgtcccctggcggctaccctggctcctactccaggtcccccgcggggtcccagcagcaattcggctactc

SEQ ID NO: 13477 - DNA, 428 bp, Homo sapiens
tgagtcatcgtaagccaaacattaaaattctataacttaaattgaactgtcatatagtttttgccatttgaggcttcaagagtcaaattaagcctgctttaaacactttgaaagacagtgctctggggaagaaaatgctagctaaatctgagcatctcacgttatgcagaaattattgcccttatcttcattcataatgaaagtgttggtgaaagaaggaatgaagcagaaaaatgatcactggattggaaacaaaactcctctgttttagcccttactctgcttctaactggacaggtgaccttgggagaaaaaatttaacttccatgggtcttatttttctcattgaaaaaacccagagcttaatacagtcgattctcattatttgcagtagtaatgttttataaagttgctggaaacaccaaatt

SEQ ID NO: 13478 - DNA, 583 bp, Homo sapiens
gggattacaggtgtgagccaccgagtctggccctgtgatccatcttgaagtaatgtttgtatattgactctatttttgtttgcttttactttaccctcacctgactgataaagttgagagatcctcattattttcttcttgtggggtaatggcagaagactgctctgtaacttttaccaaacaccttaccgagttgctgcagccaattcgtttatatgtcactgaaaactcagacaaatcgagtcatttctctgctttttaaaataattactcctcatcacactttcagggcctccaggggcctggtttgaaagcagaacattcaggaaagccataggaaaacagcatcctggcttaacagctcattgagaacgggccaggatgacaatggcggctttgtggaatagaaaggcgggaaaggtggggaaaagattgagaaatcggatggttgccgtgtctgtgtagaaagaagtagacatgagagactcttcattttgttctgcactaagaaaaattcccctgccttgggatcctgttgatctgtgaccttacccccaaccctgtgctccctgaaacatgtgct

SEQ ID NO: 13479 - DNA, 545 bp, Homo sapiens
aaggaaaaccagcaaataacaagaaaaccatttaatgtaaagatttgtaaataatcacttcaaaagaagtgccttgttgctgtcacatttagtccatcttcatataattcttatctgggccagtttcttgggcatgggacatgtgcagttacacaagcctgtgctcttaagagggtcttacccatagtttaatgttctgctgttgtagtcttgaaattcttaatgatttaacaaggggtcctccattttcattttgcactgggccctgcaaattacatagcccatcctgatttctacaactatagaatagcacaatgggaattccatatggattaataatatgtgacacttacggctttttctatacgcttccaagtacttcatataaattacttcatttcattcaatggtagaattggtagatgcttaacttttaatgaaagacaaagtcagattcactctaaggattaaaaaatatatgtaacattacattttaaagattttcaaaaacaatttgttgtggaaatgaattattgtcatgagat

SEQ ID NO: 13480 - DNA, 580 bp, Homo sapiens
aatcatgtgtgcaaaacatgggggaaaacatactttaaactaaaatatagttttaagagacaaatgtatatgatagtttcaagactggcaactagtgctgataatttatttttttgctaaactaattatgcctatttttactactgtcattctggctatcagatatctttctgttagatatcaaattcccagagagccatgttctacccagaggtgtttctttgctctgtttctgaatcggaaaggaaaacaaagagcagtaaaattattttcaagagattaatcataatgtcaagaacaaagctgagatttgattattgacttagaattctgtccactagattatacccttactaattatctatttttcttcactgtgaatctgtcaggctgaggtcacacagtaactgggaaacttgctactccctgctatcttttagccttgaattaggcctgtccaacccttgggactttcataagggaaataaatattttgtgagggcaagaagggcagcttttagaaataaattctattcttttccttattatttatagctctgaatgatatttaatttaaagc

SEQ ID NO: 13481 - DNA, 407 bp, Homo sapiens
ccaaaccacgaagttgttaaatgtacactaaaagggggtgtaacggaattattttcattctgtgtttgaaaatgacattgtatcttgagagtgaccatacaaactctttgctaaatttcattaattgaaactcatgtatgttcagacaatttttattttcataaaagagcatgccaggctgggcgcggtggctcacgtctgtaatcccagcactttgggaggccgaggcgggcggatcacgaggtcaggagatcgagaccatcctggctaacacagtgaaaccccgtctctattaaaaatacaaaaaattagctgggcgtggtggcgggcgcctgtggtcccagctactcgggaggctgaggcaggagaatggcgtgaacccgggaggtggagtttgcagtgagccg

SEQ ID NO: 13482 - DNA, 349 bp, Homo sapiens
aggacaataaatgaaaactaggactctcccaggctaactaaaacataacagttagtttacagatagctacataggaattccaagaaaaactcagtttgggttgtcagagaatggtttggaggaaatcaaagggctacaatttataaatgggaaagttacaagtaaatgtagaggcaagaatcctgaaatgaacatgtgaaaatacacctagaaggaatatgttagaatgggaataaatgtggctaacatctaaaactgggctttagaactaaaggagttaagacatttttatagaattcagtcttttggtctccataaaaaatgaggccggccgggtacagtggctcac

SEQ ID NO: 13483 - DNA, 341 bp, Homo sapiens
ctgctgcaagaagacaacagaaggctactgctgcaagaagacaacagaaggctgctgctgcaagacgacaacagaaggctactgctgcaagaagaccacagaaggctacggctgcaagaagacaacagaagggtactgctgcgaagaccacagaagggtactcctgccagaagacgacagaagggggagcgccgctcctgctgcaccgtgcttgctacgagtttcatgctcgtgctaaactagcgccgtcgtcttctttcttcagtcgtcatgatgattatctaccgccacctcatcacccacgatgagatgttctacgacatctacaagatgcaggagat

SEQ ID NO: 13484 - DNA, 283 bp, Homo sapiens
agatgatgtttcctccgccaggacaatcatatcctgattcagcccttcctccacaaaggcaagacagattttgttctaattctggtagactgtctggaccagcagaactcagaagttttaatatgccttctttggataaaatggatgggtcaatgccttcagaaatggaatccagtagaaatgataccaaagatgatcttggtaatttaaatgtgcctgattcatctctccctgctgaaaatgaagccactggccctggctttgttcctccacctcttgctcc

SEQ ID NO: 13485 - DNA, 431 bp, Homo sapiens
aaattagataataaagtgcttttagtaacatgcctggcacagttcattgattcaaacatgtgaaaaaaaatttttttaattatcatagtagtgtgtacctttggaaaaattagaacttaacagataaggctaagtttgagccttccagtcctttccttctctgcatactcttcaggggtaactgggatcatgttctgggagcatgtcattccaagtctgtttctttgcttttataaacacatctgtttccatagaaatgctgtagtgtttgcagagggggcggggcgtggtatcatcctggatttgttattctgcgcttttttgcttgacctaccttggatggctctctagtcgttacagcttttaccttttaactattactcagtattcttactaaggtaagactatgctgatgatgtttatatttctct

SEQ ID NO: 13486 - DNA, 642 bp, Homo sapiens
gacaggagtgaaaccctgtctcaaaaattaaaaatcaatagataaattcacctagaactaagcatttttagcgtttagtatgtggagtttcagtatttgtagtatgtggtgtttgtcatttatagtaacacacatgagaactacgagatgagacagtaaagggagctatgttgtggtaaaatttctacatttaacttgaagtggtagaaaaaaactctgattgtgaaaagtatgtattttgtaatccccatagtaagggttagtaaaccatattccacaggccaaatccagcccactgcctgtttttgtaaatacaattttgttggactgtagttacacctcattcattgcatatcatgtatggttgcttttgcactacagcatcagatttgggtgttgcaacacacattgtatggctgacaaagctcatcatatttattgtatctggccctttacagaaaaagtttgccggcccagtgtagtgactcttgcctataatcccagcactttgggaggccgaggcgggtggatcacgaggtcaggagttcaagaacagattggccaaaatggtgaaagtccacctccaccaaaactacaaaaattagccaggcgaggtggcaggcgcctgtaatcccagctttt

SEQ ID NO: 13487 - DNA, 429 bp, Homo sapiens
gacactgcactccagcctggctgatagagcgagactccatctataaaaagtaaaaaagaaagtcttcagtgagaggagattcgccctatcagctatgaaagcacagaggggaggaacatggagtaggggctgcctgcagtcagatcctgccctcacaaccttgccagggaaacaggctcgtgggtacaaaggttgtgtgcctcaacttcctcatggaagcacgtgagattattttataaccatagagtggagacagtcagtatgaccaccaaacccaggagccatatattaaaatactgataaatttaactatataaaaaaatttttacaggtgtgcaccactatgcccggctaatttttgtatttttggaagaaacgtggttttactatattggccaggctggtctcgaactcccgacctcaagtgat

SEQ ID NO: 13488 - DNA, 581 bp, Homo sapiens
  misc_feature 465: n = A,T,C or G
ggcacgaggaaaagaaaaaaaaagaatttaaaattctgttttagtggagtcatttgaacttaagtctaagtttataacaacactggcttccacagcacaggaggtgagcatgtgttaatatttaagattggcataactccctttaggtgcaagtgttcaggccaaaatgttcctgaggcattttgattcctcctcctgctgcccatctataccaagcccagaaactgtctggaatatattttagtttcctgaatgacaccaagaagtagaacagtcttttcaaaaatgtattttaaaaataagctgaatctcaagaatctgatctatagtataatgaaaactgaaaagtgaagtagtcattgggatactctactgtctcacttaattctcacggcttccctgcaaggtgggtaaaattgttcctacagatagtcaaattgagttttacagttagaaaatgattgngctaggatttgagccaatgtctgtcagattcctgagtttctgctacttctactaaaatatgctgcttcttgtgtgtccggtcttctgtttgggacaagcagatgatatccctaaca

SEQ ID NO: 13489 - DNA, 316 bp, Homo sapiens
cagagtacgaggctgagaggatgcaggtgtcctcctaggaggtttgagtcagaaggcacgaggcagaagcagtgggggaggactccctcagtagagcgaggaggaggcccctcatccaagaggaggttggagcacaggggggtctaggtttgcagtttcgggaccggtagctgaggggtcccagggcctttcttctgtgaaggagaatgtgtccaccgtggggagggggtcgggagagagagatacttcagagtggacagggctgagaaagctttatgggccgcgaaaggcagagtagttgttggtggatgagggt

SEQ ID NO: 13490 - DNA, 360 bp, Homo sapiens
aactggccaaccagtatgagaaattccacagtccatgggaaagagaagagtatagtgactgaggtgggtctctctgtccaacatgcaggcagcactccctcatcctgctcagtgagagaattcagggggaatagaaaagctgctgagagttggtaaagaggatggtcgagtgagatggtgttgacctccctggatcttatgtcactacatcctggacctcaagagggtcatccaagctttttgaaagctgaactccttgactggagaaacctagacaagaggcggggccaggtgcttgatatctaggaggcattcttcctcttcccttgccaccatggagctgggcacagtaagccatat

SEQ ID NO: 13491 - DNA, 473 bp, Homo sapiens
aaggtgacccataagtcctacaaggtgtctacctctggcccctgggccttcagcagccactcctacacaagctggcctggtgccagcatcagctccttgagcttctctcgagtgggcagctgctgtagcttccaaggtggcctgggcaccagtatgggtctgggtggaggctatggcgggaccagtggtatggagggcatcacagccatcacagtcaactagagcctgctgagcccccttaagctggaggtggaccccaacatccaggccatgtgcacccaggagaaggagcagatcaagaccatcaacaacaagtttacctcctttatcaacaaggtatggttcctggagcagcagaacaaggtgctggagaccaactggagcctcctgcagcagcagaagacagtttggatgaatgtggactgcatgttcaagagctacatcaacctatggcagcagctggacatgctggg

SEQ ID NO: 13492 - DNA, 112 bp, Homo sapiens
gagagcaagtggtctggaggaatattacagtatgttgccatatgaagagaatgctattgtctgaatgcttgtgttcccccaaaattctatgtagaaatcctaactcccatga

SEQ ID NO: 13493 - DNA, 377 bp, Homo sapiens
gatggcagtgcgtacattctggacttccagtatccgttctcagccgtgcaggcctttgcagatgccctggccaacgtgactcagcgcctcaaatgaagagactggtgtggggaggagagagatgcagagagcctttggaagaggtcttcggagatgccagaggagccctctaggggtccgatgcctgggaggaccagaagccaacagcaaaactggaaaagcccggcaggcccaggagagggcgctgacctgtggtcgtcatttatttggttgggttttattaccttttattgtctgttcttcttttcttctttcatttcagggggatttggaagcaaagagtgctaggcacctgctgttctttcaggaaacagctt

SEQ ID NO: 13494 - DNA, 559 bp, Homo sapiens
cctccagaacatccgggtcactcctaagaatccaggatccagacccagtacacacatatcaggagctcagatttcccacatcaggaagggaaataaagactactttcttaggccgggcgcagcatctcacacctgtaatcccagcactttgggaggccgaggtgagtggatcatgaggtcaggggttcaaaactagcctggccaggatggtgaaatccagtctctactaaaaacacaaaaattagctgggcatagtggcgggcacctgcaatcccagctactcgggaggctgaggcagagaattgcttgaacccaggaggtagaggttgcagcaagtctccatcgtaaataaataaagtctatattctttgagggcccaaacaagatgctttcaaaggcccaatcttccctcccttttaaaaagtgtgctctcgccaggcgcagtggctcacgcctgtaatcccagcactttgggaggctgaggtgggcggatcacctgaggtcgggagttcaagaccagcctgactaacatggagaaatctcatctctactaaaaata

SEQ ID NO: 13495 - DNA, 402 bp, Homo sapiens
atataagcagtactctttctcagtttctcttgaacattcaactcattagtgagtggttttccccagtcatttccatttttctttatttggctctgatagttttctgtttttgtttttcagagataatcctttactatactaaattctacgtgattatattttccacctctatttgcctatatttatctgctgtcttttccttttccatatatgggcttattttttttttccctcttcttccttttctacctttggtatttaaaaagttacttaggactgagtgcactggcttacgtgtgtaatcccaccactttggcaggctgaggcggaaggattgcttgacccccggtgttcaaggctgcagtgagctacaatggtgcccctgccactccagcctgggca

SEQ ID NO: 13496 - DNA, 572 bp, Homo sapiens
tacaacccagttagggcagaatggaggcaaatgaataatattcccttggtctcagagaccaacatctacagaattatcaagcatggccaaaaattgttgctcatcacctctcgcaccccacagtggaaaaagaaccgggtgactgtgtatgaatatgatattaggggagaccaatggattaatataggtaccacattaggcctcttgcagtttgattctaactttttttgcctctctgctcgtgtttatccttcctgccttgaacctggtcagagtttcctcactgaagaagaagaaataccaagtgagtctagcactgaatgggacttaggtggattcagtgagccagactctgagtcaggaagttcaagttctctttctgatgatgatttttgggtgcgtgtagcgcctcagtgaaatgcacaggatcaacagggtttgttgtaactagattgaaacactaagttgtttttactgttttggaaaatatcttaaatatcctttttgttcctaaaggagaggaaaagttgattaacttctggtttggtttagaaaaagtaatgtttgaaata

SEQ ID NO: 13497 - DNA, 521 bp, Homo sapiens
ctccgacgaccaggagccctaccctgtgactgatatttcggacctgatccgggattcctatgagaaatttggagaccagtctgtggagcagatcgagcacctacgttacaagcacaggatcagggtcctccaaggccacgaggacaccacaaagcagaacgtgcttcgagtcgttatcccggaagtctcaattcttcctgaagacctagaggagctctacgacttattcaagagagaacatatgatgagctgttactgggagcagcccaggcccatggcctcacgccacgaccccagccggccctatgctgagcagtaccgcatagacgcccggcagtttgcacacctgtttcagctagtctcgccctggacctgcggggcccacacggagatcctcgccgaaaggacgttcaggctcttggatgacaacatggaccagctcatcgagttcaaagcgtttgtgagctgcctcgatattatgtataatggagaaatgaatgagaagattaaactattataca

SEQ ID NO: 13498 - DNA, 95 bp, Homo sapiens
tccgagtctcagcacctagactaattaggatgacctcagagatgctgaagagtacctttggtcagcctcagactttttgtttttggttttttttg

SEQ ID NO: 13499 - DNA, 526 bp, Homo sapiens
ggcacgagagtttaaaaatacttctttgtaaaagttattgcacaaagaaaagacatgaatgtgtccctgttatgtactcacaaggataatgatggggttgttgctcattaatactgtttcttgtgcaataacttttacaaagaagtatttttaaactgatcattaattttatgaccacagaaatgagatgcaaaatttatgctattgtcagtggcacaggctcacagcaccactgacattttgtgtgattgtaatagaatggctgccaactaatgattctgtagacatttcatttgagtgtgcttttctttagatgtgtgattagctgtaatgctttcacttatgtctgtaaattatattggatatgtttacctgatgcctattgttgatttggagttcagttttgtattacataaatgcaagttgaactttttttttttaatttatagaagtctttgcaggtataactacaaatactcagcccctggggaggaaaaatgctttgcactactcaacagtaacccct

SEQ ID NO: 13500 - DNA, 162 bp, Homo sapiens
cccaaagtgctgggattacaggcgtgagccactgtgacgggccttacatgcaatttttatttatagccagtattagagaattactaggaaatttcatttttatatttagtgggagaaagccatctacagcatgtcttcaagcatggactatctgtaacatac

SEQ ID NO: 13501 - DNA, 485 bp, Homo sapiens
gaattcggcacgagggcccagtcagggagttagttagtggtagactcagcaggagttggttgctattcagatgtgttggggaaagtgacaggcatagctgactcggggtcattcactaagccaggagcccaggaagacacacagatgcaagcagagatcgtgccattacactccagcctgggctacagagtgagactctgtgtcaaaaaaaaaaagaaagaaaatgggcttgtgtggtagcaggtaagaaattgaatctctgttgtacagcagctagctgtactgcatgatcacttgccattccccagctgacagtggctgtctctggaactcctaccacagtcttcaattggtaggccagccctggtgccagtgattttatctgggcatggaaaatgccacttgcttctgtggaagagacacttaaaagatctggcagtcggccgggtgcggtggctcacgcctataatcccaacactctggga

SEQ ID NO: 13502 - DNA, 409 bp, Homo sapiens
  misc_feature 353: n = A,T,C or G
ggcacgaggagtatggaccgtgtgctcccaggctcctgacatagggtcatgaattagggccgagtgggagcgcagagcccctcccagtcacccggcagcagaagcagcccggcttttggaggacattgtctcctggagcagtgtcagtcccaaaaggtaactcagccctgcttctctcggctcagggttgacagtgacctgggaatgacttctacaacgtaattacgaattcactcagttttagaatatatttagtagtctcagaatcgctaattcatacccccatgaaaagcaaatttactacctaaagtacagtacttggatacaggtctttttgtctttactcttatggnatttagtcaaaatactgttttccaaagttgcttaccccttttctttcctaccactg

SEQ ID NO: 13503 - DNA, 416 bp, Homo sapiens
ggcacgagggaacacgttcaggggattgtgaggtcttgcacaagccacgtggggcaccttggcttcccggcaggaggtggacacccagccagaggcctggctcaaggtgacctcaccttcaccatgggcttcctgggtgcgcgggcctgagcgcaggttgttttgtacatattggaatatgtgttaacttatgccccgcatcccaactcacacggaagcacgggtcttgtctcagtctcttcgctgcatttggaaagcagtctcctctcgggccagcgccgggctgaggtgtccagaggcggcggcagctggcagtgccctcagcccccaagtgtccagcctggcacttcccattcaggccacctgctttgggtcaacagttcctttgccagcagcatctcctaaattgaaggact

SEQ ID NO: 13504 - DNA, 685 bp, Homo sapiens
  misc_feature 456, 462, 503, 515, 534, 545, 546, 685: n = A,T,C or G
tccagggtggaatccaagtcaaaaatgaaaaaaacagaccatctctgaaatctctgaaaactgataacaggccagaaaaatccaaatgtaagccactttggggaaaagtattttaccttgacttaccttctgtcaccatatctgaaaaacttcaaaaggacattaaggatctgggagggcgagttgaagaatttctcagcaaagatatcagttatcttatttcaaataagaaggaagctaaatttgcacaaaccttgggtcgaatttctcctgtaccaagtccagaatctgcatatactgcagaaaccacttcacctcatcccagccatgatggaagttcatttaagtcaccagacacagtgtgtttaagcagaggaaaattattagttgaaaaagctatcaaggaccatgattttattccttcaaatagtatattatcaaatgccttgtcatggngagtanaaattcttcatattgatgacattagatactacattgaacanaagaaaaagagntgatttactcacgaatcangacttcattannagatggggcaaaaaagttgtagtggtgcccataaaccagacaggagattccaaagctttttgtaggtggagattggaccaacttataggcactttatctcgctgacaaatgcctttatattattcattcaggcctgctn

SEQ ID NO: 13505 - DNA, 365 bp, Homo sapiens
aggatgtagaccagtgctgtcaagctctctctcaaagactgggaacacaaccgtatttcttcaataagcagcctactgaacttgacgcactggtatttggccatctatacaccattcttaccacacaattgacaaatgatgaactttctgagaaggtgaaaaactatagcaacctccttgctttctgtaggagaattgaacagcactattttgaagatcgtggtaaaggcaggctgtcatagagttatgtgttagtctcaggagtcttaacttttgaaatatgttttacttgaatgttacattagatattggtgtcagaattttaaaaccaaattactgctttttgaaacctcaaattatataat

SEQ ID NO: 13506 - DNA, 353 bp, Homo sapiens
  misc_feature 125, 145: n = A,T,C or G
agtccagcctgggcaaaatagcgagagaccctgaatctgaaagtaatgataaaataaaaagaatataaatgaagtctcgttgatgctggacaattcaagaattcagacttgaaccttaaacctangaaaagttactttgtatcangattctaacaattatgcttcatatttgtgaagtcctttaaaactaattttctcaagttctttctttgagacctcaatctgtcttagcattttgtaactaataactgaaattgtattcaaaggaattgtaaaccttaaaccaccaatttatttccatgtgaaaaagtgttatatatgacaagtgttttttgattgtaattgcgttaaat

SEQ ID NO: 13507 - DNA, 77 bp, Homo sapiens
ggatgtttttgcaaatcaaaagaacaatgcatgaaagggaatgacccttcctttctgtcttgagatattatcttatg

SEQ ID NO: 13508 - DNA, 546 bp, Homo sapiens
tcttaacttttctgaacctgtttcctcttttctgaaattagaataatccctccttcctagagatgttagcggaaggattcagtggtctacccttggattggaaaacattgtctttagagggtcatattgtaaatgttttctgttttgtgagtcatatagtctctgacactgcaagagcagccttagatagtatgtaaacaaattagcatggtcatatatgcccaggcagcgggtcaaatttgtcccccaggctactttgccaacgctaaatataaagctgttagcacactgcctgtatacagcaggtaattaaatgattccctaccaccaacactaccccctagttccatcgcttctggcaactgcataatcatcaagaggtagactttgggccgggtgcagtggctcacacctgtaatcccagcactttgggaggccgaggcaggtggatcacttgaagtcaggagttccagaccagcctggccaacatggtgaaactctgtctctactaaaaatacaaaaaaaaaaaaaaaaaaaaaaaatttt

SEQ ID NO: 13509 - DNA, 112 bp, Homo sapiens
aaccctgagagttcccatatgtgttctcaagagtcctcaaaataatattctccaagataattttttaaaataatagacttggctgggcacagtggctcacgcctgtaatcct

SEQ ID NO: 13510 - DNA, 504 bp, Homo sapiens
gcatggcaggcttgtcttgaggaatattatcaggcatatgtaaacagacgctggggactggcttgtgcagttgaactggccctcttgcttttctatcactgccatgaagagaagaacatccctcaagtagtagattaggctaagaagtatgagagacaaacatagaagacctggattacaacttcatcttggagttaagcccagccaaccccagctaaatcagttgagtccaagctgacccacagatgcatgaataaatttattcaattcggccgggcgcggtggctcacgcctgtaatcccagcactttgggaggccgaggtgggcagatcacgaggtcaggagatcgagaccatcctggctaacaaggtgaaatcccgtctctgctaaaaatacagaaattagccgggggtggtggcgggcgcctatagtcccagctaatcgggaggctgaggcaggagaatggcgggtgaacccaggaggcggagtttgcagggagccgag

SEQ ID NO: 13511 - DNA, 491 bp, Homo sapiens
gaggtgagcagaggctggtcgggaagtttcccggaggctcgccccgggaaccccgccccgccgccctggaagcccctgtctgctcgctggcttacccctaggacgggcagctcaccacttctcccggtcagttctgtttaagagaagctcctttctgcctgtaagcaatgaagtggaatgatcaccacaaagtggtgtaagaaaagaaaagtagacccgcagcggggtgtattcgtgctactgtttgtgtaaaacacagaaaaaagaaaggggtggtctgatgtatagtcatacacaccagtggttttggagggagtttttgtggatataccacattctctccatttatcagggattttgccctgacatccctccaccaccacgacatttggcaatctctgaagacatttttggttgtcataactggggaagtggagaggcgatactggcatctagtgagtagaggcctggaatgctgctaaacattctgc

SEQ ID NO: 13512 - DNA, 399 bp, Homo sapiens
caccatggtgcgccaggtcccgacggctccgcgccagatcccgcccactacagggagcgagtcaaggccatgttctaccacgcctacgacagctacctggagaatgcctttcccttcgatgagctgcgacctctcacctgtgacgggcacgacacctggggcagtttttctctgactctaattgatgcactggacaccttgctgattttggggaatgtctcaaaattccaaagagtggttgaagtgctccaggacagcgtggactttgatattgatgtgaacgcctctgtgtttgaaacaaacattcgagtggtaggaggactcctgtctgctcatctgctctccaagaaggctggggtggaagtagaggctggatggccctgttccgggcctctcctg

SEQ ID NO: 13513 - DNA, 414 bp, Homo sapiens
ggcacgagcctcatcagcaagccagtgagagggtgcctatccgaggatgatattccatcacctctgtcagattctgcttactagtcagtccccaggcccaggccactcgcaaggggaggacattacaggaggcgtgagtataggtggtgtgatctgtggggaccgtcgcagaggctgtccaccacaaggggttaaaacctataaaacttcgaagttggatttaataattctcaattactaggaaatagataaaaacaaattttctgtacttcacagaacactaaagtatgtattggatattgtatcccccctgaattttgctgtgtgagtgcttcccagttgaagcagtaattcaagttcattaatgtttacttcaaagccgaagtggagtcttgactcacacagttcaacgct

SEQ ID NO: 13514 - DNA, 119 bp, Homo sapiens
catttccactctttttggcctttaatcactcatgatagccctttaatgtgtcccttaaactctatgatgtttgatagtgaaacgaggtgttgaaagcatattttctggtactgctgctt

SEQ ID NO: 13515 - DNA, 501 bp, Homo sapiens
ggcacgaaaaacaattgaaattggactggaaatggagtgggcgaagtaaatacacacgttaccagagtgttgagtttgggcactcttaacagtcattattactcagtgtttattgataaatcagacaaaattgccatcttagttttgagtgtctaaattaggtgataatggttattataatttggttattttgcatgactcaagctagtaagtaaatacactctgtaatctcaaccaattttttaatttgttaaatactatcattgtcaacatcttttttcatttgcttcagacttaatgaacaagccagtgaggagattttgaaagtagaacagaaatataacaaactccgccaaccattttttcagaagaggtcagaattgatcgccaaaatcccaaatttttgggtaacaacatttgtcaaccatccacaaggtatgttttggacagggcattgttaaaggataaacagtgtttgttaaaatggaggaagcttggtga

SEQ ID NO: 13516 - DNA, 472 bp, Homo sapiens
acagtgtaccgcggggagactgcctccctgctgtgcaacatctctgtgcggggtggccccccaggactgcggctggccgccagctggtgggtggagcgaccagaggacggagagctcagctctgtccctgcccatctggtgggtggcgtaggccaggatggtgtggcagatctgggagtccggcctggaggaggccctgtcagcgtatagctggtggggccccgaagccatcggctgatactacacagcttggggcccgaggatgaaggcgtgtaccactgtgcccccagcgcctgggtgcagcatgccgactacagctggtaccaggcgggcagtgcccgctcagggcctgttacagtctacccctacatgcatgccctggacaccctatttgtgcctctgctggtgggtacaggggtggccctagtcactggtgccactgtccttggtaccatcacttgctgcttcatga

SEQ ID NO: 13517 - DNA, 594 bp, Homo sapiens
ctgctgttgttggggggtttgtggagcgctgtgggagcgtccagcctgggtgtcgttacttgcggctccgtggtgaagctactcaatacgcgccacaacgtccgactgcactcacacgacgtgcgctatgggtcaggtagtgggcagcagtcagtgacaggtgtaacctctgtggatgacagcaacagttactggaggatacgggggaagagtgccacagtgtgtgagaggggaacccccatcaagtgtggccagcccatccggctgacacatgtcaacactggccgaaacctccatagtcaccacttcacttcacctctttctggaaaccaggaagtgagtgcttttggtgaggaaggtgaaggtgattatctggatgactggacagtgctctgtaatggaccctactgggtgagagatggtgaggtgcggttcaaacactcttccactgaggtactgctgtctgtcacaggagaacaatatggtcgacctatcagtgggcaaaaagaggtgcatggcatggcccagccaagtcagaacaactactggaaagccatggaaggcatcttcatgaagcccagtgagttgttgaag

SEQ ID NO: 13518 - DNA, 322 bp, Homo sapiens
aaaactcaagaattgttattagaaaataaatctaggccacacatggtggctcacacctgtaattccagcacttcatggggctgaggtgggcggatcacaaggtcaggaatttgagaccatcatgttgatgaaaccccatctcgactaaaaacacaaaaaattagcccggcatggtggcaggcacctgtaattccagctgctcatgaggctgaggcaggagaatcacttgaacccgggaggcagaggttgcagtgagctgagaccacgccactgcactctagcctgggcaacacagcaagactccgtctcaaaataaataaat

SEQ ID NO: 13519 - DNA, 417 bp, Homo sapiens
  misc_feature 236: n = A,T,C or G
taaaagcctttgcgttcaactgtaaaaacagcaaccctcttctgggccccctctccatgacagagagctttcttctttcacttattaaactttcgctccaacctcaccctttgtgtccacacttcttaattctcttggttgtgagatgaagaactccgggtggtacttcacaatgagacactgctacattgtgatgcattggcgagactgtaacagtaagatctacattaaattanggaaattagtatgggggtctatattctgtagctttgccagtttgttcttaggattttctgttttgcctatgaattggggtgcagggagacggagttgagcaaaaaaagcaaaaagatctttccatacccgtccttccgctgagtggggcttttgtaaaagaatgagatattacaaccttat

SEQ ID NO: 13520 - DNA, 396 bp, Homo sapiens
ggcacgagcgggtcctgccggtgccacatggggtaccagggcccgctgtgcactgactgcatggacggctacttcagctcgctccggaacgagacccacagcatctgcacagcctgtgacgagtcctgcaagacgtgctcgggcctgaccaacagagactgcggcgagtgtgaagtgggctgggtgctggacgagggcgcctgtgtggatgtggacgagtgtgcggccgagccgcctccctgcagcgctgcgcagttctgtaagaacgccaacggctcctacacgtgcgaagagtgtgactccagctgtgtgggctgcacaggggaaggcccaggaaactgtaaagagtgtatctctggctacgcgagggagcacggacagtgtgcagatgtggac

SEQ ID NO: 13521 - DNA, 533 bp, Homo sapiens
ggcacgagggatgggcttgatctcctgaccttgtgatctgcccgccttggccttccaaagtgttgggattacaggcgtgagccactgcgcctggccatcaggtaacctttatggctctttcaggaaaagtgaaatcagagaggcgtaccctaaccacagctgtagtattctgctcttctttcctttttggtgagcttcatgggtggagttatcagtggtctgtactttgtggatattttgcccaccatgaagtattaaacacatcagtctagaagcattgtgaaaaggttccaaaacgggagacaaaatttaattcattcctcagttctgaaagtttgtgctttcttaccatgaatagatgaaaacttgaaaaaaatcttgacagtttactaatgtgaatcacatgtaacgtactactaattctacaatgcctttctctttagtcagcattaaaaatcttttttaaagtattggtatgaaaacaaatatttgttgccctgatcatggaattttaaaactacccacagtttaag

SEQ ID NO: 13522 - DNA, 390 bp, Homo sapiens
ggcacgagtgtctttacgtttcacaaccatggaaggactgccaacctctactcccttcacaactggctgggcatcaccactgtcttcctcttcgcctgccagaggttcctgggctttgctgtcttcctcctgccctgggcgtccatgtggctgcgcagcctcctaaaacctatccacgtcttttttggagccgccatcctctctctgtccatcgcatccgccatttcgggcattaatgagaagcttttcttcagtttgaaaaacaccaccaggccataccacagcctgcccagtgaggcggtctttgccaacagcaccgggatgctggtggcggcctttgtactgctggtgctctacatacttctggcttcatcttggaagcgcccacag

SEQ ID NO: 13523 - DNA, 399 bp, Homo sapiens
ggcacgagagaaaatcaagtttgaccagtgcagtttctaagcatgtagccagttaaggaaagaaagaaagagaaaaaaaaaaggcctggatactgcttttgctgtctctgttatgagatggaaaacttacatgtttgtgataaaaggggaccatgagaatgaattggcttggcttactttccccctgaaatcctctctcctgcagactgtcttgaaaacctggtgactggtaaataaagccctgcatggaggctgcacagcaggggcaagaggcccatcccccagcatctcactgaggacagcttcaggctgccttcctctgaacgtggtccacaccttcctctcctccacagagagggtgccgccagaatcccctgtcgctttctgtgtctgcaatgg

SEQ ID NO: 13524 - DNA, 556 bp, Homo sapiens
ggcacgagaaatgatatggaaatggaaattaaatgggttccaggtcttaaagaaagtgcagaagagatggtcaaaaacaaattggaaggaaaggataaactgaccccttgggaacaatttttagagaagaagaaagagaaaaaaagactgaaaaggaaacagaaggctcttgctgaagaggccagtgaagaggaacttccctctgatgttgatttgaatgacccatactttgctgaagaagttaaacaaataggtataaataaaaaatcggtaaaatctgcaaaagatggcacatctccagaagaagaaattgaaatagaaagacaaaaggctgaaatggctttgcttatgatggatgaggacgaggacagtaagaaacacttcaattacaacaagattgtggagcaccagaatctgagcaaaaagaagaaaaagcagctcatgaaaaagaaggaattaatagaggatgactttgaggtaaatgttaacgatgcacggtttcaggcaatgtacacttcccacttgttcaatttggacccctcagatcccaatttca

SEQ ID NO: 13525 - DNA, 496 bp, Homo sapiens
ggaatcccagtactgtgtgtgccctgttcactcctcctttgctttcccgttttcagtatgcttgaaacttttcaaaataaaaagtttgggagaggaggaatctaagtaatcctcataaaattaaataattaaatcaaaggccccatttccaactcctttttggattaaagaaaataatttataaatgaatagcttctataatatgaatccatctttataaaaagtaattcattggccgggtgtggtggctcacgcacggcctgtaatcccagcactttgggaggccaaggcaggcgaatcacgaggtcaagagatagagactatcctggccaacatggtgaaaccccgtctctactaaaaatacaaaatttagctgggcatagtggcttgcgcctgtagtcccagctacttgggaggctgaggcaggagaatcgcttgaacctgggaggcagaggttgcagtgagtcgaaatcgtgccactgcactccagcctggc

SEQ ID NO: 13526 - DNA, 606 bp, Homo sapiens
acagtcagaggtaaagaggtcactgatgatcttggtcagaggagtttcaggagcctgacagggacggaagccggcaagccccgaatcagggaaggagtgggaggtgagaacagatgatcaagggcagatgactcttgcaaggcgtggctgagaagcagagagacacagtgaggctcttgggggacaactggaaggcatggggcactttgattttaactcagggaaccctgagcttacctaagtgcagatggccagtcacagctgcaacccatagactaagaagccatgggccaggtgcagtggctcacacctgtaatcccagcactctgggaggctgaggcgggcggatcacttgaggttgggaatttgaaaccagcctgaccatcacttgaggtcgggagttcgagaccagcctgaccaacatggtgaaacccccgtctctactaaaaatacaaaattagccaggcatggtggtgcatacctgtaatcccagcgacttgggaggctgaggcagaagaatcactgaacccaggaggcggaggttgcagtgagccaagatcatacaattgcactccagcctgggcaacaagagcaaaactccgtctc

SEQ ID NO: 13527 - DNA, 614 bp, Homo sapiens
aagaaggggaaatgttgaattgtgttttccatcccaactggtatagagatttttttttcttttagttaaaagcaagtgattataggagaaataagcatgtagctcctatgactacgctgttttagagttagctggggaggaaaggctggggccaagcagttaccaagtgtacattgaattgttttaaagttgataactagatattcgaatgaatatatagggccattcaacatagtcaccattgagctatctttagagcacagggcatttaataatgggcatctccctgtggagagatctggagctcaggagcattcaggatttccatgcccctctctctctgcatcctcctgcctctaatctagctatagcaaggacactacagcagttcactctttaagagtatttctggttacccagtgaagggtgggatcaactctcccacccaaaactgggttgggtgtcaagactgattcaccacatctcaggagggtgtggaaagatgtattgctcacatgaggctttctggggagagcagggcagccatccaaacgggtctagtttttattttggttggagagtgggctggggtgaggctacttatgaatgggcag

SEQ ID NO: 13528 - DNA, 480 bp, Homo sapiens
tgctttcaataatcaagattattcatcaaatttaaaaggtaatcactgagctatctatttctcagaggaaaacatgagaaacttgaaaattaagaaagcagattgaggaaatttcacaactatgagaccattaaggaaaagaggacattacagtaatagagaatgtatggcaccttccactcacgtatcaatgcaatcagggtatatgcagcctttatcctggttcagacaatgtgatagaaaacagaaacaaataaacctaggcatagcttctgtcctcaagtaacaaactgtccagtagacagactgaaatagtaagaaaaatcttaaaactgtgaaaactaacttaatggttcaaaaataagaaataactaattaccttaaatttcagagaaagtttgaatgtatttttaacttaaaaatatgtgaataaggcttgggcgtggtggctgacacctgtaattccagacctttgggagg

SEQ ID NO: 13529 - DNA, 405 bp, Homo sapiens
accccatctctactaaaaacacataaaattagccgggcatggaggcgtgcaactgtaatcccagctactcaagaagctgaggcaggagaatcgcctgaacgcaggaggcagaagttgcatttttttaagatcacgccattgcactccagcctgggcaacagagcaagactccgtcttgaaaaaaataaaaataaaaaagatgcttgacacgtaacaggtgctcagtaaatgttggctattatttagtgacacattatttaataattgagtcagtttcctcatctgtaaaatgaaaataacattgtaatttctttgcagagtctctgagatataaagtacactgaatatcaagcatttgatctttgctatgattattcacaccgccatgatgcaactcactgtctc

SEQ ID NO: 13530 - DNA, 375 bp, Homo sapiens
ggcacgagacttgggaggctgaggcaggcaaattgcttgaacccgggaggtggaggttgcagtgagccgagatcgtaccactgcactctagcctgggcaacagagcaagactctgtctcaaaaaaaaaaaaaaaaagggttggaacaggggaacaggtggggggggggggttcacccttgtatccccacctttttggaaggccggggggggggaatcccctggggtagggatttaaaaaccacccgggccaaatgggaaaacccccgtttttattaaaaaaacaaaattttacccgggcttgggggcggggccctgtatccccactttttggggaggttggggcagaaaaattttttaaccctggaagggggggg

SEQ ID NO: 13531 - DNA, 422 bp, Homo sapiens
gaggtaatgcttcattttgcatagttgggaatcaagataatctgtttttaataatacaagaaacaaaagcataactatattatttatattacaaaagcaatctttagaaaaactaaaaggggtatataagtattgagaggagaggaaaaggaatgatatggtatcatgaggtaatttttgatcaattatagtaggaaatagacaatatctaaaatggataaagggaaaatggcaatattatctttttattttatattattttaattttttaagacaagtgctcgctctgtcgcccatgctggagtgcaggggtacaatcacagctcactggagccttgacctcctgggctcaagtgatcctcccaccacagcctcccgagtacctggtactacaggcatgccaccacacccggctaattttt

SEQ ID NO: 13532 - DNA, 416 bp, Homo sapiens
  misc_feature 416: n = A,T,C or G
ggcacgaggggagtcccaagaccctttcagggaggatctgtgaggtcaactgttggcactgtggcatgaatcaaggtggtggcagcaaacttctagtagttttgatatgtccttgatagaacaaatagcaatggttaactattaaatgttgacctagccagcgcagtggctcatgcctgtaatcccagcactttgggaggctgaggcgggcggatcacctgaggtcgggagttcgaggccagcctgaccaacatggagaaaccccgtctcttctaaaaatacaaaattagctgggcatggtggtgcatgcctgtaattccagctactcgggaggctgaggcaagagaatcgcttgaatccggtaggtggaggttgcagtgagccgagatcataccattgcactccagcccaggcan

SEQ ID NO: 13533 - DNA, 586 bp, Homo sapiens
gcaatacaaagaattcagaggaatctaaatccagttaaaataatataaactcgtatagtttcaccaaggaattatttctatgaagtcttggaaattgtccaaggtccaaactagaaagtctgagtctgaaacattactatcaaaagtgtaacattctcaactaacatgcaaataggtcatgcagagaaaatttgcctaaaatgtttgattagtgtaacctcaaaatccctaaaaaactttgttcttgggttttcttgacacaggcaaaagacattttgggggatgacaatagagttgttaagatcagattagaggggaaaaaaaggaaaaaaatagtgcttattaaaaggtcagtaatcacagtgtttattatttacatatgattttaacaattgtattaaaatcaagtatctattcaatggtgctggggaactgaattctcatatgcatatccacatggatattcagctggacactgacctcatactgtacacaaaaatggattcataatggatcatggataaaaaataagaggttaaactatatggttctttattaaaaagcataagactaaatctttatgatc

SEQ ID NO: 13534 - DNA, 566 bp, Homo sapiens
ggcacgaggagccatgcgagcagctcgttcccttggagaaagaactgtaacagaactgatattacagcaccagaaccctcagcagttgtctgccaatctatgggccgctgtcagggctcgaggatgccagtttttatggccagctatgcaagaagaggccttgaagctggtgttactggcattagaagatggttctgccctctcaaggaaagttctggtactttttgttgtgcagagactagaaccaagatttcctcatgcatcaaaaacaagtattggtcatgttgtgcaactactgtatcgagcttcttgttttaaggttaccaaaagagatgaagactcttccctaatgcagctgaaggatgaatttcggagttatgaagcattacgcagagaacatgatgcccaaattgttcatattgccatggaagcaggactccgtatttcacctgaacagtggtcctctcttttgtatggtgatttggctcataaatcacacatgcagtctatcattgataatgtttgtgaaattagagatgctgatgttctatcattgctgttacatt

SEQ ID NO: 13535 - DNA, 329 bp, Homo sapiens
tcccctagactaggactccagtgccctcctctcccaagagacaaaggccattgcattgaaggaggtgggaaatgattagattctgaacatatgtaattatttttcagtctttttcaaagatacaaatatttacatagttttaatcatgtaatatatacaatttaatgtcctagtgttttacttaatagtgtatcatgttttccctgttggtatgtagcctggataaatgctcttaattataaaaaattctgtcgaggagtgttccatagtttattgttttcctattatgagaatttaggccaagtgtggtggctcatgcctgtaatccc

SEQ ID NO: 13536 - DNA, 501 bp, Homo sapiens
cgatcttggctcactgcaacctctgcctcccaggttcaagcgattctcctgcctcaccctcctgagtagctgggattacaggcatctgccaccacacccagctaatttttgtatttttaatagagacagatttcatcatgttggccaggctggtctccaactcctgacctcaagtgatctgcccatctcagcttcccaaagttcaggaattacaagcatgagctactgcaccgggccaatcacattcattattaatcagcaagagtttatttttcatctgtggttacatggtagacacttcctaaagaaattaagatatgatgcttactataaatgttctaattatatacctggggacacaacttcactgatatgaagcaacaaataatacaagatagaatttcaattaggaggcaaaagatatgattgaggcaaccctcatttgttacagctaatgatctgggctagagaatgtgtaagagtaaagtctagaaaatgtct

SEQ ID NO: 13537 - DNA, 627 bp, Homo sapiens
gggacgccatccaggtggttcgggaggagctcaagccagatcagaaacagagagattatatccttgaaggagagccagggaaggtgtctaatcttcaatacttgcatagctacctgacttacatcaagctatcaacggcaatcaagcgtaatgagaacatggccaaaggtctgcagagggctctgctgcagcagcagccagaggatgacagcaagcgctcaccccggccccaggacctgatccgactctatgacatcatcttacagaatctggtggaattgctccagcttcctggtttagaggaagacaaagccttccagaaagagataggcctcaagactctggtgttcaaagcttacaggtgttttttcattgctcagtcctatgtgctggtgaagaagtggagcgaagcccttgtcctgtatgacagagtcctgaaatatgcaaatgaagtaaattctgatgctggcgccttcaagaacagcctaaaggacctgcctgatgtgcaagagctcatcactcaagtgcggtcagagaagtgctccctgcaggccgcagccatccttgatgcaaacgacgctcatcaaacagagacctcctcctcccaagtcaaggacaataagcctc

SEQ ID NO: 13538 - DNA, 527 bp, Homo sapiens
aggcagtcacaaaaaaactaacactgtgatttcacttatatgaggcatccaaaattcatagaatttgcaagatgaaaaaggggtggagatttattacaatgtgtgtgcaattaatttgcagacctttttaatcttgcaaaaccaaagccctgttctctttctagattgacacatttagagaaggtaagcttaggtcaggacagcacaactattggcagagaaagcccagttctcatgagcccacttctggcttgtcaatcatggcctgtccttgccctctaggaaacttggacctctcttctgggacccctcttcttgggcccctttcctttttattgttaattatgtgctttgatgcacgaagtgtcccggccccatcactctgcaaggtcactgcatctgaacagatccaggtggaaaaccttgcctgcaagtccctccttgcagctcaggcatggggctcctggtctgcgtggggccccattctctgcttctcggtgttccccagttctgggactctcatgatg

SEQ ID NO: 13539 - DNA, 395 bp, Homo sapiens; identical to SEQ ID NO: 7948

SEQ ID NO: 13540 - DNA, 406 bp, Homo sapiens
gtattgttactaaacagacaatatgtagtggaggaacactctttctcaatattagctaataaatatgtatttttaataagctgattaaggctttgttagtttctcaatgataacatcgggcccatggttctcaatcagggtatgattttgcccctcaaaggacattttgcaatatctggaggcattttcagttattataagtggggctgggtggatgctgctggcatctcatggagagagaccagagatgctgttaaacatcctataatgcacaggacaggcccccacaacacagaattatccagcctaaaatgtcactagtgctgagggtgagaaactctgacacatcgattcagtgatgttctggcaacagccaataaagtcagcaattaaaaatttgtattgt

SEQ ID NO: 13541 - DNA, 657 bp, Homo sapiens
ctctagtcctcattctactcatgcttcagtacatcagcgtcacagaccactctgccaggcaatattaggttcacgatgaaaagggagaagaagaaatgttggcagattcccgcgatactcagaaaacagtataaaaaggaccaagtggtttgaaacaggatttaagatgcaagagattacaaagaagccttccttgtagattgaatgttagcgtcaattactgatataaacatctttggggagacctcgtttgagcaaagttaatgacttctgttctggatgtgtacaatttaaagggcctataatatgttttacccatgcatcctcaacaaggatgatattgccaccaaagggggtaaaaattggttgctggggagtaaaaaaaatcttactttttatgcacaaagtatagaaaggcatatagtacataaacatttatgctactgcatatttatcaaaatttcatggagggcaattaggaaaatattgtctataacacttatgggaagcacagataatgtgaagaagtatgaagttattcaagaagtatggaatttatgtgagaatatgtgtgggagatcatatgtgtgtatgtatgcacatacacatatacatctaaaggaagtcagtgtacacacaggaattgaagccccatgc

SEQ ID NO: 13542 - DNA, 246 bp, Homo sapiens
aaccctgtctctactaaaaatacaaaaattagccgggcatggtggtgcacgcctgtagtcccagctactcaggaggctgaggcaggagaagcttgaacccaggaggcgggggttgcagtgcgccaagatcacgccactgcactccagcctgagtgacagagtgaggctccatcaaaaaaagagaaagaaagatgaactagaccagaggttggtaaactctggcccatgggtcaaatgcagcccact

SEQ ID NO: 13543 - DNA, 524 bp, Homo sapiens
cagcgttctcgggtgctacgctgctgcagctgtcgcctcttccaggcgcaccaggtaaaaaagagtgtcaagtggacatgcaaagcttgtggagagaagcagtcctttttgcggactgttcagtcagattctctgctccaagtccatagaatctcattccaagccaactggaagagctgagtctcaattataaattcctaggagaagcaacctggttggcccaggctgactcggatgcccacctctggtccagtcaactgggattgggtctcagaagagaggggctggcttaccaggtttctcaggcttatggtgaaggctctggtgctgattgtagacgccatgtccaaaagttaaatctactacagggacaagtttcagagctgccactcaggtacagttgtttgagaagagcgtggttgtcttgccctgttttcgtcttgactggataatagaagtacacagtggaaatcctgagctgggcactctgctgtggctggacctgccccaggtccctgctgtca

SEQ ID NO: 13544 - DNA, 231 bp, Homo sapiens
caaattatgctgctgtgctcatttgatgatggaatcagcatcgcatgcaggctgaacccctactacggcagaaccaagaaagccactctttcccctctcctcctaagatgccaccacagagcagggtgccagtggtgggtggggagaaagacggagacacagaaacgtctctttttcactgtgattctcctaaggaatatacagtcacccccacaggaaaagcaagagttg

SEQ ID NO: 13545 - DNA, 396 bp, Homo sapiens
attcggcacgagtggaggccccggagaccccaggagagccaccactttctcctgggttctgaacacagcccaggtgggaacaatgctgcccctcatgatgaagtggcctgtgtggcttgagcgccccatagtccccagtcagagcagagtggtgtccccagatgacttcagaccccatagctgggcaagatgcgcttgttttggactctgcgctgagcagaaccagctcccccaactcctgcagatagagaactgacttccgagagctgtaggtgaagtgaggaccaggcagcagtccagagctgtgaggccccaggcccagaggaatggaatgaagaaagacctgttccacacaaggaggggttttctagtggaagctgagcttggaagctcctg

SEQ ID NO: 13546 - DNA, 648 bp, Homo sapiens
ggcacgagatgcagtggggaatcatgacttcatagaggcatacaagtgccagaccgtgatagtccaatcattcttgcgagcattccaggcccacaaagaagaaaactgggctctgcctgtcatgtatgcagtagcgcttgaccttcgagtgtttgccaataatgcagatcaacagttggtaaagaaaggaaaaagcaaagttggggacatgttggaaaaagcagcagagttactgatgagctgtttccgggtctgtgccagcgacacccgtgctggtatagaggactctaagaagtggggcatgctgtttctggtgaaccagctgtttaaaatctacttcaagatcaacaaactccatttatgtaaacccctaattagagcaattgacagctcaaacctgaaagacgattacagcactgcacagagagtaacatacaaatactacgttggacgcaaggctatgtttgacagcgattttaagcaagctgaggagtacctgtcatttgcctttgagcattgtcaccgttctagtcagaagaacaaaaggatgattctgatctatttgcttccagtaaaaatgctattgggtcacatgcccactgtggagctcctgaaaaagtatcacctgatgcagtttgcgggagtaac

SEQ ID NO: 13547 - DNA, 650 bp, Homo sapiens
ggcacgaggttcccgcccgggactaagccggggagcgcatcccggctactgcgggtcctgggtcttcacctgcggagccttacggcagctgagcggtgggagggacctgagccgcggcgctaggatgggaaacagtgcgctccgcgctcatgtggaaacggcgcagaaaactggtgtctttcagcttaaggaccgagggctgaccgagttccccgcagacttgcagaagctgacgagcaatctcaggaccatcgacttgtccaacaacaagatcgaaagcctaccgcctttgctgataggaaagttcactctgctgaagagcctctccctgaacaacaacaaactgactgttctgcctgatgagatatgcaatctgaaaaaactagagacgctaagcctaaacaacaatcaccttagagagctgccgtctacctttgggcaactctctgccctcaagaccctgagcctctctgggaaccaactgggagcattacctccccaactttgtagcctacggcacctggatgtgatggatctctctaagaaccagattcgaagtatacctgactcagtgggagagctgcaagtcatcgaactcaacctcaaccagaatcagatatctcagatctcagtgaagatatcttgctgtc

SEQ ID NO: 13548 - DNA, 689 bp, Homo sapiens
  misc_feature 515, 575: n = A,T,C or G
ggcacgagcggagccagggactccagccccaaccccggaatctttcaccgtccacttcctgccgctcaattctgctcagactctccaccacaagagctgctacaacggccgattccagctcctctatgtggcctgtggtatggtccatcttctcatccctgagcttggggcctgtgtggcacccggagggaacttgattgtggaattagcccggtacctggtggacgtgcggcaggagcagctgcagggattcaacacccgggtcagggagctagctcaggcagctggatttgctccacagaccggggccaggccttcagagaccttcgcacgtttctgcaagtcccaggaatcagctctgggcaacactgtcccagctgtggaacccggaactccgccccttgacatcctggcccagcctcttgaagccagcaacccagcccttgagggcctgacccagcctctgcagggtgggaccccacactgtgagccctgccagctgccctctgagtctncagggtcactctcagagggtcttgctcaagctcacggggcctttgcttcggccaactggngagacaattccaaaatgggagtgggaccacccctagaccccttaaattcaacttcaaagccggtgaagaaagaacccgtgaacaatctaggccgtgctaagcctcatttatcag

SEQ ID NO: 13549 - DNA, 397 bp, Homo sapiens
ggcacgagactggatgtatagcagtttttccaagaagcttggctcagaagggtagcagacaggatgacaaatggaaagagaaatgaggtcactggaggattgttaaagagtacagcatgtttgagtgtcacttgaaaggttccagtggagaagctgaagaagtaggtaaaggtaagaataaccaagggacagaagtcctggagcagggaggagggaatgggattctttaaaacctcttcatcaagaaactaggaaaaaaaaccaaagctgtaccatctcagatttcagagaaagggaatttagaaggaagtaatataagcaaagaacaacaatattctgtgactgtttttaataataactaggaaaattcctagtgcagttaactctgaacaaaatt

SEQ ID NO: 13550 - DNA, 595 bp, Homo sapiens
ggcacgagatgcattgttggtgttttgggatgcaaggatgaattctcagaatttatctacaactaaagactcacttggtgcatattcagagacacatagtgatgatgtcactcaagtacgtttccatcccagcaatcccaacatggtagtctcaggttcatctgatggcctggtaaatgtatttgatattaatattgataatgaggaggatgcactggttacaacctgtaactcaatttcatcagtaagctgtattggttggtctgggaaaggttataaacagatttactgcatgacacatgatgaaggattttattggtgggatcttaatcatctggacactgatgaaccagttacacgtttgaacatccaggatgtcagagaagtagttaacatgaaagaagatgctttggactatttgattggtggcctatatcatgaaaagacagacacattgcatgttattggaggaacaaacaaaggaaggattcatttgatgaactgcagcatgtcaggactgacccatgtgactagccttcagggagggcatgctgctacagtccgttctttctgttggaatgtgcaagatgattct

SEQ ID NO: 13551 - DNA, 576 bp, Homo sapiens
cagagccagagctggggctcaaacgagctgtcccggggggccagaggccggacaatgccaagcccaaccgggacctgaaactgcaggctggctccgacctccggaggcgacggcgggaccttggccctcatgcagagggtcagctggccccgagggatggggtcattggccttaaccccctgcctgatgtccaggtgaacgacctccgtggcgccctggatgcccagctccgccaggctgcggggggagctctgcaggtggtccacagccggcagcttagacaggcgcctgggcctccagaggagtcctagcacctgctggccatgagggccacgccagccactgccctcctcggccagcagcaggtctgtctcagccgcatcccagccaaactctggaggtcacactcgcctctccccagggtttcatgtctgaggccctcaccaagtgtgagtgacagtataaaagattcactgtggcatcgtttccagaatgttcttgctgtcgttctgttgcagctcttagtctgaggtcctctgacctctagactctgagctcactccagcctgtgaggag

SEQ ID NO: 13552 - DNA, 581 bp, Homo sapiens
actaactttttctaagagaaattgattcctgttttgtcatctgatgcaatttgctcttataaagagacattttcataggttcagagtaactcacctccatgggctgaccaaaggcttttctaatttttgttactgatgagatgaaacctatttgtaaggagatcttccccaggagcatttctgttgccttcttgacatcaatgaaaagtagcatattctcttatgaaatagcatgagaaaacacagggcatttctaggacagtaaaacgttaaagtactggattaagaaaacaacaacaggctgggcgcagtggctcacacctgtaatcccagcactttgggaggctgaggcgggtggatcacctgaggtcaggagtttgtgaccagcctggccaacatagtgaaatcctgtttctactaaaaatacaaaaattagctggatgcgatagcacgtgcctgtagtcccagctactcgggaggctgaggctggagagttgctcaaacccgggaggcggagattgcagtgagccaagatcgcaccactgcactccagcctgggtgacagagcgaccctctgtctc

SEQ ID NO: 13553 - DNA, 532 bp, Homo sapiens
cttgtgtggtgcactgtgctcctgtctttagggacccgtgaagacaaacttcttccttcatgatagtcatttccatgcgtctgtgtccatactatctctggttaaaacaaatcccaggtacattttaaaacacggatggtggtagatcttgcatggaatggtgatctagtcacatatattttatatactctggaaatgatgcaaaaattggctacaagaaagcttatatctctccttgtaatcttctataacaattttaaactaactttttctacatacagcatgttgtttcctagatgaggcgatgaaattctttatgcagcaagagttttccagtatatttcaaaataccttattgtgaatgtttttgaaatgtgtaattactatctgattaccatatgttaaaaattttaccaaagtaatgtaaaatattggattagatagtaaaatagaataagcactccataagaaatgtttttcctaagaatggaatatgtatgggtttagaagattggatggataggccgggcgc

SEQ ID NO: 13554 - DNA, 485 bp, Homo sapiens
gtttactatttgagggaaacttgttcctgtaaattttcttaaaaatatgagtatatggcatgtgcaattttattgaaaatggaagacaattcaagttttccactatttctagctggatttcaccaccggaagctgagttaagtagagggatgataaactagctattttggtactattctgaaaatatgtgatacaaaagatataataatatggcatacacctttttaaatgttacaccaaataactttaacagtgatgcaaaaagtatgattttaaaaaattttccagctgggtatggtggctcacgcctgtaatcccagcactttgggaggccaaggagggtgcacctggaggccacttgaggccggaagtttgagaacagcctgaccaatgcagcgaaaccccatgcctactaaaaatacaaaaattagccaggcgtggtggtgcacacctgtagtcccagctacttggaaggctgaggcaca

SEQ ID NO: 13555 - DNA, 94 bp, Homo sapiens
aaaatatatatgtaataataacaataaattaaataaataaattccaattcttgcccacgcacagtgactcacacttgtaatcccaacactttgg

SEQ ID NO: 13556 - DNA, 300 bp, Homo sapiens
attcatgccagttcttccctgaatggcagaagcactgaagaagtaaagcccattgatgaaaacttggggcaaactggaaaatctgctgtttgcattcaccaagatataaatgatgatcatgttgaagatgttacaggaattcagcatttgacaagcgattcagacagtgaagtttactgtgattctatggaacaatttggacaagaagagtctttagacagctttacgtccaacaatggaccatttcagtattacttgggtggtcattccagtcaacccatggaaaattctggatttcgt

SEQ ID NO: 13557 - DNA, 395 bp, Homo sapiens
aaagaggatgtgctaagcaaacaagcattgtaaacaatatttcagaggcaaggttttggcctgctttaaaaaaataaaatgtttgcaagtacaattaaaaaccagtataagggacaggggtgggatgaaaacctgtctctaagattacgaagcctgcgttatttcccctaaatccccttcgaggaagatttgaatccctcatcaacaaattttcattgattatgtttctattatatatactgtagactctatattcacgaatgtaatcatactcattcagaaaaatataggaagagaaaatgagtatgacctgtagcctgaatttcattataaaagatttaaaaatatacattttatattaaaattgatgtaatcttttaattatgaagtctttg

SEQ ID NO: 13558 - DNA, 496 bp, Homo sapiens
cgagaactgacctaagcctcagtttttcagatctgtagtacttactttacatgattgctctttgaattgaataacataatttatgtgaaaacacttaattatgaatgctgtaaaactatcaaagccattaatatgtgttatagtagcatcatacattttgcagcataatccagagaacaaggagttgttaacaagggagaggaagataatctggttgggctagtattatactctcaggtgctactgacttcttagatgaccttcaagatgttagtacaactctctacttggagatgctattttctggggatgttaatatccactctattcacaaaattttaagaaaagtcaagtagcatggatgaaactctccaaagttctgcttaaaactaaaatatcttagttgtcactgaagccacagatattttgtgaatgcagcatgttcccaataagcagtccctcttagcctcacagtccaagctggcaacaggatcac

SEQ ID NO: 13559 - DNA, 648 bp, Homo sapiens
atcaaacaattgtagatcccttcagttcaaaacataatgtgattgtgggcagaaatggatctggaaaaagtaactttttttatgcaattcagtttgttctcagtgatgagtttagtcatcttcgtccagaacagcggttggctttattgcatgaaggtactggtcctcgtgttatttctgcttttgtggagattatttttgataattcagacaaccggttaccaatcgataaagaggaagtttcacttcgaagagttattggtgccaaaaaggatcagtatttcttagacaagaagatggtcacgaaaaatgatgtgatgaacctccttgaaagcgctggtttttctcgaagcaatccttattatattgttaaacaaggaaagatcaaccagatggcaacagcaccagattctcagagattaaagctattaagagaagtagctggtactagagtgtatgacgaacgaaaggaagaaagcatctccttaatgaaagaaacagagggcaaacgggaaaaaatcaatgagttgttaaaatacattgaagagagattacatactctagaggaagaaaaggaagaactagctcagtatcagaagtgggataaaatgagacgagccctggaatataccatttacaatcaggaac

SEQ ID NO: 13560 - DNA, 589 bp, Homo sapiens
tctatagatcaaaatgcgttaatttgaagtagtaataataatgatgcagaggatgacgaggatgatagatgattactatatgtgagacactattctaagtgttttacatttatttacttatgagaccctcactataatcctatgaggtaagcactattattatataatatggacgtacaaagagcttaaataattttcttaaggaatatagctagtaaacgtcataatcaggattgtgaatcagtctggctccagaaccagtgatcttaaccactgtgctatacagtatagggttactacttgtaagccagttttatgctagagaaaagctatctcacctctaaacgattattggttttagaaaatgtgcctctcttttaaatagtgattcagtcttatagctaatggtctattaaggttactcatatttaatgacaataaaactgcacctcacatgtatgataatgtttttgttggccgggcgtggtggctcacgcctgtaatcccagcactttgggaggccgaggtgggcggatcacgaggtcaggagatcgagaccatcctggctaacatggtgaaatcccatctc

SEQ ID NO: 13561 - DNA, 495 bp, Homo sapiens
ggcacgagcacagctgtgcagaacttaacgccacgcgctgctgttgctgctgctgctccccgggctgttgccccctacaaatacgcctccagtgtccgcagccctcatcctgccatacagcctctgcaggcaccccagcctgcggtccatgtgcaggggcaggagccactgactgcctccatgctggctgcagcacccccccaggaacagaagcagatgctgggagaacgcttgttcccactcatccaaacaatgcattcaaatctggctgggaagatcacgggaatgctgctggagatagacaactctgagctgctgcacatgttagagtcccccgagtctctccgctccaaggtggatgaagctgtagcagttctacaggctcatcatgccaagaaagaagctgcccaaaaggtgggcgctgttgctgctgctacctcttaaacaaggaaaaaccgattcaaaagccaaataaccccttatggaattcaactc

SEQ ID NO: 13562 - DNA, 403 bp, Homo sapiens
ggacggctgcatttacggggtctcccggagggccagagtcgtggcttacagaagagacgaaatgtggtctgagggacgatatgaatatgaaagaattccgagagaacgagcacctcctcgaagtcatcccagtgatgaatctggttatagatggacaagatacgatcattctgcaagcaggcaacctgaatacagggacatgagagatggctttagaagaaaaagtttctactcttcccattatgcgagagagcggtctccttataaaagggacaatacttttttcagagaatcacctgttggccgaaaggattctccacacagcagatctggttccagtgtcagtagcagaagctactctccagaaaggagcaaatcatactctttccatcagtctcaacat

SEQ ID NO: 13563 - DNA, 497 bp, Homo sapiens
ttggttcgtcacaaggcatcgcagaaggtttatgctatgaagcttcttagtaagtttgaaatgataaaaagatcagattctgcctttttttgggaagaaagagatattatggcctttgccaatagcccctgggtggttcagcttttttatgcctttcaagatgataggtatctgtacatggtaatggagtacatgcctggtggagaccttgtaaaccttatgagtaattatgatgtgcctgaaaaatgggccaaattttacactgctgaagttgttcttgctctggatgcaatacactccatgggtttaatacacagagatgtgaagcctgacaacatgctcttggataaacatggacatctaaaattagcagattttggcacgtgtatgaagatggatgaaacaggcatggtacattgtgatacagcagttggaacaccggattatatatcacctgaggttctgaaatcacaagggggtgatggtttctatgggcg

SEQ ID NO: 13564 - DNA, 137 bp, Homo sapiens
ctgtcgtatacctctttgttatgatactgataaattgtgatcttgcagtcaatcactgattttctgtggtcagaggattcattattaacctcttcatggattctatcttctgaaacccttttttctttcttttcatt

SEQ ID NO: 13565 - DNA, 353 bp, Homo sapiens
gttcaagtgattctcctgcctcatatatagctgctttattgagatgtaattcacatattatgcaattcacccattgatgtaattcacccaaatgatacaattcaatggtttttaatctatttacccagtggtacaatcattactacaatcaattctagaatgttttcatcactgcctagggatctttaaaaattccaaagcccagactatgccacaaatcaattatatcacagtctatggcggtgggacacagacatcagtagtttgcgaagctccccaggtaattccattgcacagatatgtttgggaagccatgctgcactggaatcactgtcagagtttcagggaaaata

SEQ ID NO: 13566 - DNA, 564 bp, Homo sapiens
tgaataaaatataaacatgttttattggtggtcttggttttatttatagctagactgtgaaggttccttcctttaatatctgggttactcccttcctctctagaccacttacattttttctaattagtctaagcaaagcaaacagaatgagtccaagcaccattcacttaagcaaaagaagatttaatgcttaaaaaaatcctgttataaccccaaacgttagagagtcagaggtcagcaaagaagagttctagtttgtggtgtctttggtggatcatcacagtgatgaaggcatcagtgtctgagccttcatcacactagtcttgtatgatcctcgattaactggcattcatcctcaagatgaagataattcaaaaactattgaattatacactttatttatttattttgaggtggagtctcactgtggctctgtcacctaggctggagtgcagtggtgcgatctcagctcgctgcaacctctgcctcctgggttcaagtgattcttctgcctcagcctcccaagttgctgggactacaggcatgtaccacctcacccaacta

SEQ ID NO: 13567 - DNA, 538 bp, Homo sapiens
tcccaaagtgctgggattacaagcgtgagccaccgcgcccggcctagatcgattttaaacttttaaaatcttaagtaattcctttttttgcttgatggttttcttctacctcaaagcggggactatatcttacattttcttggtattcgatacagtgcccaggatagctatggaaatacagctgatggatggatgggtgaatgagtggatgaatgaacagttggatgaaagaaagacgaatgaaaagcagatggctgggttctacaacagctgctgatttactggatgtggggacagaaggggttaaaaattaaatcaacttgagggactcttcaacttgagcagctctttactctcaaagataaaattgggataattatcttaattctggtaatcattagtgcttaaggctcaacatttttattgtgcttcaaaccacagaaaatccacagataacaactgtgattcacttgtgactttccacaggagtcaacttgtcagacatggccctatagctacttgcgtagggctggagctg

SEQ ID NO: 13568 - DNA, 55 bp, Homo sapiens
gatgacaactccctggcccattgtgagcagcagcatcagaatccaaggcatgtcc

SEQ ID NO: 13569 - DNA, 474 bp, Homo sapiens
acaaagatagtatctggaatcagtgagataaaagctaacttcttaataaatggtgctgagacaactgggtagccatttggaaaaaagggaaaattggacacatatctcacaacaaacagtaataaacaccatatggattaatagtctaaatgtaaaaaataaaatcatgcaacaacaagaaggaaacctgaatgaatcctctgtaatcttggtgtagggaaaggctttttcttaatattactcagaatccaggggcagtagaagataaactgatacattttactacagaaaaataaattttgcataaccaaaacactataaacaaagtcaaaagacaactgacaaacttggagaaaatatttgtaacatacaacaaaaggctaatatccctaatatataaagaacttttaaaccttgagtgacaaagtctgggtgtggttgttcacactggtaatcatagcattttggaaagct

SEQ ID NO: 13570 - DNA, 475 bp, Homo sapiens
  misc_feature 347: n = A,T,C or G
tacggctgcgacaagaccacagaaggggctcccccggccgggctcgcctctcccggcgcccgcctcatttgaaaacacggcctttcccacgcccttaccgccggttctgcccgcgctgcgctccgctcctcgcccctctgctcgcccttcgctttcggcgtcccacaccatctccttccctcgtcggcggcttcctcttctgctcccaccctggtctcccgcctgccttccagcaccatctctttcggatgtcattcctcgcagtgaagttctttattgaaactgccccttgctgtcagcaccccaaatctactgagggtccatcagcagtacagactggccggctntatgtgctaggtcggctcttaagaaatatactttaagcctaacggcctcaaaaaaaaattgtattatcaaacatagagtgtgaaaataacactgaaataattttaaactaaaaggctaggccgggtgc

SEQ ID NO: 13571 - DNA, 255 bp, Homo sapiens
cttgagaatggaggcaggcacctccttggaagggaataattaactttcacgttgcctaatcctgcatttctggtgttaatctagtggtaggtttatagctgaagctttctacttaagccgggtttaaaaacacgtccacaaaaggatattttcttataaaaccagagttggcccggcgcagtggctcacgcctgtaatcccagcacttgttcgagacaaacctggcgaacatggtgaaaccccgtctctactttt

SEQ ID NO: 13572 - DNA, 558 bp, Homo sapiens
ggcacgaggcagcttttagcagcctggcaagagctgtgtcaaagtgacctatccctggaccggcagcttaccggactctatgatgccttgcttggtgcttggcacacacaaatccagtgggctacacaggttttccagaagccccacgaggtggtaatggtgctgctgattcagaccctgggggccctcatgccctcgctgccctcctgcctcagcaacggcgtggagagggcagggcccgagcaggagctcaccaggctgctggagttctacgacgccaccgcccacttcgccaagggcttggagatggcactgctcccccacctacatgaacacaatctggtaaaagtcacggagctggtggatgctgtgtatgatccatacaaaccctaccagctgaagtatggcgacatggaagagagcaacctcctcatccagatgagtgctgtgcctctgcatggggaagtgattgactgtgtgcaggagctgagccactccgtgaacaagctgtttggtctggcgtctgcagccgttgacagatgcgtcagattcaccaat

SEQ ID NO: 13573 - DNA, 66 bp, Homo sapiens
taaaataatttgggaggggccgggtgttgttcggtgtgtgtgtgtgtgtgtgtgtgtgtgtgtgtg

SEQ ID NO: 13574 - DNA, 98 bp, Homo sapiens
ggcacgaggagagagagagagagagagagagagagagagagagagagagagagagagagagagagagagagagagcgagcgtgtgcgcgcgcgcgcgc

SEQ ID NO: 13575 - DNA, 523 bp, Homo sapiens
ggcacgaggccctcctgatccccagctgtcctggggccctgaccgacctggccagcagtggctccctggcccgtatcctgcagcacttccactctgagagcaaacccatctgcgccgtcggccacggtgtcgctgccctgtgctgtgccaccaacgaggacagatcctgggtgttcgacagctacagcctgacagggccctctgtgtgtgagctcgtcagggcccccggcttcgcccgcctgccgctcgtggtggaggacttcgtgaaggattcgggcgcctgcttcagtgcaagcgagcctgacgctgtccacgtcgtgctggaccgccacctggtcacaggccagaatgccagctccaccgtcccggccgtgcagaacctgctcttcctctgtggcagccggaaatgaacctgctgggtagatgcaccccctgagacagcccaggtgtctccagaggcagccccgtctcaggcttcagggaccccgcctcttccctcctgacattgagcccagcattgaag

SEQ ID NO: 13576 - DNA, 85 bp, Homo sapiens
tggtcgtggtcattgttgcttccttcttcatattgaagaacttcaaccccacagtgaactacatattgtccataagtgcttcatc

SEQ ID NO: 13577 - DNA, 114 bp, Homo sapiens
ggcacgaggaagagagaggcagtggcagagggggggcaccttttatttctatttttaaagggacaggacactaattctaccccacttcaaccttgaattcaggggggtgggggg

SEQ ID NO: 13578 - DNA, 122 bp, Homo sapiens
gggtttggtttgctttggtttatattttttcagttgtttgtttttgcttgttatattaagcagaaatccctgcatgaaaggtactatatttgctagactctagacaagatattgtacataaa

SEQ ID NO: 13579 - DNA, 409 bp, Homo sapiens
ggcacgaggccctctggggttggcctcaaactgtgatcacccacacacccactttctgttgggtggcggctctaagaggagctccactggattcctgaacaggagactcaccccctcccctggccctgggcagagggagaacctgggccctgggtcagtggccccagagcagtgtctgcctcccacaggctgccacaccctgtacctgagctcagtgagcgtggagaccctgactggagccctggccgtgcagaaagccatctccaccacctttgagagggacatcctccccacgcccaccgtggtccacttcaaagtcacagagcagggcatcactctgactgatgtccagaggaaggtgtttttccggcgccattacccactcaccaccctccgcttctgtggtatg

SEQ ID NO: 13580 - DNA, 110 bp, Homo sapiens
ggcacgagcctcaaggcagttcaagcaattctcctgcctcagcctcccgagtagctaggactacaggcgtgtgccacctctcccggctaatttttttgtatttttagtag

SEQ ID NO: 13581 - DNA, 140 bp, Homo sapiens
gttttctgcatagttcttaactaatcttgtctgcagtttggtattgataatattagcatggccacttatgctgaatacacaataagatacatttaaaaatccttaatgtactggttaggtcagtggtacaactgtttgac

SEQ ID NO: 13582 - DNA, 645 bp, Homo sapiens
cttctccgttgatgtgaataatgtggtactcattttaaatggaagagaaaaagcaaagatcttttatgccacccagtggttactttatgcacaaaatttagtgcaaattcaaaaactccagcatcttgctgttgttttgctcggaaatgaacattgtgataatgagtggataaacccattcctcaaaagaaatggaggcttcgtggagctgcttttcataatatatgacagcccctggattaatgacgtggatgtttttcagtggcctttaggagtagcaacatacaggaattttcctgtggtggaggcaagttggtcaatgctgcatgatgagaggccatatttatgtaatttcttaggaacgatttatgaaaattcatccagacaggcactaatgaacattttgaaaaaagatgggaacgataagctttgttgggtttcagcaagagaacactggcagcctcaggaaacaaatgaaagtcttaagaattaccaagatgccttgcttcagagtgatctcacattgtgcccggtcggagtaaacacagaatgctatcgaatctatgaggcttgctcctatggctccattcctgtggtggaagacgtgatgacagctggcaactgtgggaatacatctgtgcacca

SEQ ID NO: 13583 - DNA, 164 bp, Homo sapiens
cacacaggtcccggggcatcaggagaaaggctgggtcttgggaccttgtcctccccagttggcctactgttacacattaaaacgatttgcccagctcaaaaaaaaaaaaaaaaaaaaacttctgggggcctttttttcgtaaaacccaaacttaaaaaaaccct

SEQ ID NO: 13584 - DNA, 253 bp, Homo sapiens
aaatgtttctgatgtgaataaataactgaattttacgtttttctctaattttagtgaatttaaacttagttacatttggctagtacttctatcttagcctgtctcaaaaatagcactaaagatgaggaataccaaattcttctctaaaatcttccacaatttcattggctgatctccaccaaatatctcctttgtattttattttcctgtctttaaaatggtgcttacaattcatagtctctaagtaaaaaca

SEQ ID NO: 13585 - DNA, 60 bp, Homo sapiens
tagttaaatagccttcatactgtggatttttcctcctactaactaatatgtgggaaatta

SEQ ID NO: 13586 - DNA, 144 bp, Homo sapiens
tggtcttgaactcctgacctcaggtgatctgcccgcctcagcctcccacagtgctgggattacaggtatgagccaccacgcccggcccatttttttttttgacaactttttttttttaaaacagggttttgttcctttgcccaa

SEQ ID NO: 13587 - DNA, 308 bp, Homo sapiens
catttttttctatcatgttcttaattttcattccttttctatagcattctattcttgactcaagaatgtaacattttgtctgcatatattcatttttttgaagttttcttattcctgcatagtctattgcttcatgtattttttttgtttttgttttcttttggtctctgtcatgttggaaacttttctcaattgccttccttaggtaactgcataatgtgatgtggaagattcaaaagttgattgccttatctaaattcgacagtttgaaacttccctttaagctgatctgggtcagccattttggg

SEQ ID NO: 13588 - DNA, 541 bp, Homo sapiens
  misc_feature 466: n = A,T,C or G
gtcatgtctccacactcctgctagatgtactccaagagagcaaagtctctatttctaatattcctggctttgtgcttggaagctagcaaatctatgaactatgtattgaataaatcaaaaagcacaccatgattttattttgccaaccattttatgtattattagaaccaccagaaataaatgggtgggggattctagaaattactgtaataatacagtagaaaatctaacaaattttgtgacccatcagaactcaaaatggcaggtaagatttcagaactaaagttcaagcacggtaagaataagtctaaaaaggaacaatttagcatgcattgacttcctaacaccctcagattacgtgttattttggagagagaagttaacacatgttgaccacctatgaagtaccacttgttaatatacatcctatcagcgaatcctcaaaatatttccttggacaccgcanaacagatcgggagagtttaagctcttggccgaggacagagccagtaatggctctgtcattacaacatacaagggc

SEQ ID NO: 13589 - DNA, 147 bp, Homo sapiens
gaactacaccgaccatgatgtcatcaaatgggtgctctacattggccgcactggcatttatgaaactcgctgctatctgccactatgcagctatcccacctccccaaccaccctcctccacaggtccaggtgccgctccctccccca

SEQ ID NO: 13590 - DNA, 669 bp, Homo sapiens
accttaagcctattcttcctatagtccattttttatttgcacagtagacataacattaatagttctattagctttttgatggctaaatgaggtaaaagagagtgcttagaaaaatatctggcacttgataagctctcagtaagtgtttgctataattatttctttatttgagttgttatatgaggaataattaaaagattacaaaaatagcaaatgaagatgattaaagccccatttttaaaatgcagctggatatttgaaatgaacagaattatcctgcctagagtaaatcattctcttaattctctcttgacaatagtcccactgaaaatgtgcccatttactatgctttaattcaatttttttcattaattcaaacaaataaacatgtactgaacacccactaagttccagagcagatgcagtctaatgtggagatgcaaagaaaaataaggcagagtctctgtcttcaagaaattaatgatgaaaagggaaattgatattggcacagaaccaaatgaccagaaaaaatgctttagcccactccctgattcacaggcttacttaaaaaatgttagtgaacatttcatagcaactgataatgcaggtaaaactaagagcaaagaactgtagcttgcatgcatttgtatatgaagaactccttttatg

SEQ ID NO: 13591 - DNA, 118 bp, Homo sapiens
agtcagaatctgtaacaatttaaattaacaacttaaatgtcaaagaatactttctaagttgattgctctaagaaaataaccaaatgggccgggcgtggtggctcacgcctgtaaacct

SEQ ID NO: 13592 - DNA, 490 bp, Homo sapiens
catacaacagcagcatacttattaccttgaattggtgatttaatagaggcacagctggtagcacaatacatattgtttaaactatttgagcacatctggtcatatcctattaaatcatttaaatccaggtaaaattggggacctccccacgtccatgggaattatgacagaaaactttccgaacagcaaaacacatgcaaggagacacagtaatacctacagaaaaaccttactagtattcaagttaaattaggtatttgttggaccctgggataaatgtggaaattgacaaacacaattaaaagacttactttggccaggcgcggtggctcaggcctgtaatcccagcactttgggaggccgaggcgggtggatcacaaggtcaggagatcgagaccatcctggctaacacggtgaaaccccatctctactaaaaaatacaaaaaatcagccaggtgtggtggcaggcgcctgtagtcccagctactcg

SEQ ID NO: 13593 - DNA, 378 bp, Homo sapiens; identical to SEQ ID NO: 8194

SEQ ID NO: 13594 - DNA, 452 bp, Homo sapiens
agacgacagaaggggagacagagtcttgtcctgtcacccaggctggagtgcaatggcgtgatctcggctcactgcaacctccgcttcccaggttccagcgattctcctgcctcagcctcccaagtagctgggattacagaaaaatggatggacatgttttactgcctgaacgctggtgccagttaggccaacagtcatgtggcaatggctatgaattgcaagcattgctgattgttatctgctgctactgcctttgagctggagcggaacagatcaacatgggccaaacaagagcctctttggagatttctctactgcttcaagcacacagattccaagtttagaagctcaagagaaggttgaaaataaaatacatttagtttttgtcatctacctgggattacttcactattggaaaagaatatcacaagataatataaataacaaattac

SEQ ID NO: 13595 - DNA, 447 bp, Homo sapiens
agaatttatgcccttgcctgactggctgccttatccaattcagcatgctggaacttaaaaatattggccgggtgcagtggctcacgcctataatcccaacacatcgggaggctgaggcgggtggatcacttgaggccaggagttcgagaccagcctggccaaaagtggtgaaactccctctctactaaaaatacaaaaaattaccggggtgtggtggcagacgcctgtagcccccgctactcgggaggctgaggcaggagaatcgcttgaacccaggatgcagaggttgcagtgagcggagatcgcaccactgcactccagcctgggtgacagagcaagactccatctcaaaaaaagaaaaagggggggatactggatcatgagcaaatgtccactgatgctatcagcacggcgatggagactggcccatggatgggggcaagccgc

SEQ ID NO: 13596 - DNA, 644 bp, Homo sapiens; identical to SEQ ID NO: 8203
  misc_feature 406: n = A,T,C or G

SEQ ID NO: 13597 - DNA, 663 bp, Homo sapiens
ggcacgaggtctgacctcgcacagctgcccatgcaatgatgagtggatcaaacactacggcttatacaagatgctcctcacagaatgaaaaacagctgctcattttcagttagctattagccttttagccccacccttgttttctctttttttgagacggagtctcactctgttgctcaggctggagtgcagtggtggtgccatcttggctcactgcaacctccaactcctgggttcatgtgatttgcccacctcagcctcccgagcagctgggtttacaggtgctccaccacacccggctattttttttgttttgtatgtttagtagagatagggttttgccatgttggccaggctgctcttgagctcctgaactcaagtgatccacccaccttggcctcccaaagtgctgggatgacaggcgtgagccatcgcacctggccagccttacccttgtaatgaagcagtgaagtacagctggcccacatctcagccaacatcatcttctgacagaatctgcttcatacaaacgcattacacacaacaggacacaatgcacatgccttgttcataccctcagagctgcctggcaaataccatggtttggggacgaatctacactagacctgcctggctgcagtggtaacactccattgcctaact

SEQ ID NO: 13598 - DNA, 614 bp, Homo sapiens
ggcacgagtgagataggaccatgtgctttgagagtgtttagtatcttaaaactcctgtacaaatgcatagcaccaggcagacagtaggagctcagtttacagcatgaatggtgggtgctcttatactcagaattccatctgctcctcccagtgccagactccttcctcgaacccagagccttctcccatagtatctctttagcctcttgggaactctggactgctccccactgaatgtgccaacgcccccactcaccactgcctggctttcactcccagtgtcatggacttggttccaaagggctttgagaacctcacaaaaaaacccactccaaatctttgagggtctaaagggaagattctggccccttcccagagacccatctactgtagggacaggaaaagaagacctggggggtagggaggggtagatggtaaatttccttaccaagaaaaatgccagccaggtgcggtgtctcatgcctataatcctagcattggaaggccaaggtgggcggatcacctgaagtcgggagttcaagaccagcctagtgaacatagcgaaaccccatctctactaaaaaaatacaaaaattagccggtgtggtggtgga

SEQ ID NO: 13599 - DNA, 600 bp, Homo sapiens
ggcacgaggctgaacgcgcggtcaccctcggccgccgcacccagcgcacttcccggcgcgattcctggacgcacactgcaggaccaagggcacgcagaggtcggagcctgcccagaagccacacctggccagaaaaaccgaaggtgtatcaaggtgtccgagtgaagatcacagtgaaggagctgctgcagcaaagacgggcacaccaggcggcctccgggggaacccggtccggaggcagcagtgtccacctttcagacccagttgcaccatcttctgcaggactgtattttgagcctgaaccaatttcttccacgcccaattatttgcaacggggagaattttccagttgtgtttcatgtgaagaaaactcaagctgcctcgaccagatctttgattcctaccttcagacagagatgcacccggagcctttgctcaattccacacaaagtgctccacaccatttcccagacagcttccaggccacccctttctgctttaaccagagcctgatcccaggatcaccttcaaattcctccattctctctggctccttagactacagttactcgccagtgcagctgccttcatatgctccag

SEQ ID NO: 13600 - DNA, 404 bp, Homo sapiens
ggcacgaggtctgatgttggcctcaggaagggacggtactacagtgtaaatgtgcccattcaggatggcgtacaagatgaaaaatattaccagatctgtgaaagtgtactagaggaagtataccaagcctttaatcccatagcagtggtcttacagctgggagctgacacaatagctggggatcccatgtgctcctttaacatgactccagtgggaattggcaagtgtcttaagtacatccttcaatggcagttggcaacactcattttgggaggaggaggctataaccttgccaacacggctcgatgctggacatacttgaccggggtcatcctagggaaaacactatcctctgagatcccagatcatgagtttttcacagcatatggtcctgattatgtgct

SEQ ID NO: 13601 - DNA, 376 bp, Homo sapiens
ggcacgaggggctaccaatttgagaccattggtctggtagatacactttcattaatatacttactccatcactctttctatattttagaagttactagtagaaatgtatgcaggagtcactggagaccttattaaaatgcagcttctgattcagtgagctggggtggggcctgagagtctgcatttctcccaggctccctggtgctgccagtggtgctgctctgagtaacaagggggtggggaatgatatggagccgtccattattatcccatctgacaaatgagtcacagagcccttaggtaattgaggtgggatcagtctgattctgtaagctgtgttttcagccacaacatttactgcaaacttggagtaggg

SEQ ID NO: 13602 - DNA, 414 bp, Homo sapiens
tggcatagtgagggaggctgggacccaggtgctagagtgactgatggctagcaggaggttgggagatgatggtgttgagggaggagtagaacggtggttggcaaggatggcatgggcatcaaaggaatggaagttttttatggaggtgaaagagcacaggttggaaagagcaataggaatgagcttggggaacgcactctgcttcttgccctgtttacttataaagaaagtatgtgtaatcccagcactttgggaggccaagttaggcagatcacgaggtcaggagatcgaggccatcctggctaacatggtgaaaccccatctctactaaaaatacaaaaaaatttagtgaggcgtggtggtgggtgcctgtagtcccagctactcggaaggctgaggcaggagaatggcgtg

SEQ ID NO: 13603 - DNA, 659 bp, Homo sapiens
tgaaggacctgcctgcggctgctttacagtttgtttgtttttttttaaaataagtagaagatatacactaaagtaatgataaatgtatagtatagtaaatacacaaaccattaacagttgtttattttcaagtatatgtactgtacattaattgtgtgtgctgtacttttatacaactggcagcatggtaggtttgttcacaccatcttctccacaaacctgagaatcgtgttgttgcactgcaagtcattaagttaggaattgttcagcttcattataatttgtgggaacataagatgtccttaaatagcacataactgtaatgtgttttttttaacatcttggttttttcagcagctatgttagtatccagcagataactggcactctggacatttgatgggtgaaaatattcacggttcattcttttcttcgaatgagccccaataatcattgcctcctgaattcctctatcaatattttgtcctatcatttgacatttttagacatttaaaacttcttagtaagataggacattactgtaagagcatttgtctgcatatactatttcagtttttttcccctttgtctgagttaatttctctatctactgttcacagtaaagagttccataacatactaacacttgacctaaacag

SEQ ID NO: 13604 - DNA, 346 bp, Homo sapiens
aaaagcatcagcaccatgagattcacctgcctctggtcgttagagatggaatttcaacatgttgcccagactggtctggaactcctgtgctcaagtgattcgcctgcctcggcctccgaaagtgctgggattataggcatgagccaccctacccagccaaaaagtataaatactcttagacagcaaaaatgctttctcccagtcttgttcccttgttctcagttcccaccctgcctggataactactgttcttggtttcttgtgttaaagatggatcttgatagtctcgtaccagattcaaaaatcagtcaactacttcaaaaacaatgacatgctggctacttaa

SEQ ID NO: 13605 - DNA, 399 bp, Homo sapiens
ggcacgagagcagaagattctctcagtcctggtttctccctccagaagaccccccacccaaatcctctgtagctcctggtagtgccctgacccctgctgccaccgtccttcagagagcaacggaagagcttcccggagggcgaggaaaagagggaaagtagccagcaatgtcgaacgcaatgtataataagatgtggcatcagacccaagaagccctcggtgctttactcgataaagagcctcagaagatgattgaaccacaaagaaatcaggttttcatctttcaaacattagccaccttctacgtaaagtatgtgcagatctttagaaacctagagaatggctacgaccaggtcgtccacccccagaaacgaatactgatcaggaaagtcctggacg

SEQ ID NO: 13606 - DNA, 484 bp, Homo sapiens
tgcctatctcccacccctcgtttcctcacaaagcaagccatagagactagaattcctctttctcaacctaaaaaaacgtctgtaactttcccctgcctttctgtgtaagatctggccatcaagacattttttgacctaccttccctcattccaggaagggtcctgtcctgtacccgggaggaagaaatgctacacagagaagccaagatgaatctgaacagacagcctttgtcagttccacagattccataaaagttaactccagagcagagaatgatgccacagtcgggataacatccaatatttgcaatcagaagaaatatgaaagtcttgctccatcacccaggctgcagtgcagtggcacgatcttggctcactgcaagctccacctcccgggttcacgccattctcctgcctcagcctcccaagtagctgggactacaggcgcccaccaccacgcccagctaaatttttttgtattttt

SEQ ID NO: 13607 - DNA, 526 bp, Homo sapiens
taactacaagtaactgggcagggatggttagctgggaggtatggatttcatttccattactaatgcctgcaattgctgataatagacgtgccccaggaatcgctgcaagggaaatggagcaagggtctccttctgtggcccagtctggaatgttagtggtgcaatctcgactcactgcaacctccgcctcccggattcaagaaattctcctgcctcagcctcccaagtagctgggattacacgtacgcaccaccatgcccggcaaatttttgtatttttagtagagatagggtttcaacatattggccaggctggtctcaaactcgtgacctcaagtgatctgcccgcctcagcctcccaaaatgctgggattataggcgtgaaccatcacaccgggccattccaatcactcttcatttcctgcatctcaaagcaacgctgtcaaacagttggagttgattttctaggcctttctgttttccccctcctgcttgccattgcagggcctcctctggtcactcgtacc

SEQ ID NO: 13608 - DNA, 413 bp, Homo sapiens
tacaaaaacaaacaaacaaacacaaacctctcaaaatatcagatctagattttttttttctcagtacggcttacttataggtggtaatcgaagctatcagcacaaaagctgatatttccttaaaaccttgatagcttttggcaaatgaagctataagcttaaaaattcaaacccattaagaaatactttcactacatagaaattttagagaaatttttctttatcaaatgattctttgctttgcaaaatggtcaacccatatattatattatgtactttccacaaataatctgtattttttaaatcttccctaaaaagcaaatttttggtaaagaatggctgatgacaacattcatgtgtaatttctttgctgtagcattaaaaatcatttgcgaagcacaaaatacatacca

SEQ ID NO: 13609 - DNA, 565 bp, Homo sapiens
taattgttgaacatctttggaaagctataattttcacctgcttgcaacttgcataaagcaaattccatagcagagtgaagaatattaaagacctctattagagggagcctcttcagttacccaagggcacacagttcacttggatagtcagtctcctgggagtaattattttagattgtattccttattccagaagacaggtgttttcacatcacagatcttgggaaagtgtccatgacctctgtaggccttctatcctattgccctgaattagagaaaggaacgcaccaacagttctccagaatcaattctaattattaaaccctatttagaatttatgcttaattctcttatatagttattttataaatttgctcagtaaaccagtatatacagcataatccccttatttaatgtatgtcagggccaaatttaaatgaatattctcagccgggcgcggtggctcacgcctggaatcccagcactttgggaagccaaggcagacgaatcacgaggtcaggagatcgagaccatcctggctaacacagtgaaaccccgtgtctac

SEQ ID NO: 13610 - DNA, 446 bp, Homo sapiens
  misc_feature 392: n = A,T,C or G
taagcctgtctcctcatcgataaagtggatacattaatagaatcttcaacgtggggttgttgccaagataaatgagttaatatatgtaaaatgctaagaacagtaccaattacttattattataagtattattatttatgcattgatgccatgtccaagaaaggcttcttgagttcctgctttccgactgccccaggcctctgagtcaggccatgaacaggaataatgactaagaaacataaacctcatattgattatttcttttgagatagagttttgctcttattgcccaggttggagtgcagtggtgcgatctcaactcactgcaacctctgcctcccaggttgaaacgactctcctggctcagcctcccgagtagctggtactacagngtgcgtgccatcatgccctgctaatttttgtatttttagtagagatggggtttt

SEQ ID NO: 13611 - DNA, 561 bp, Homo sapiens
gggctctgaagtctttttatttcaacttcttggaatcaccaccttgttaatgaacatcaaaatcttttgtgtcatttatcagattaattactttttccataaaaagagtgagttgagaggataacaagaaactccctgtccctgcttcatcctgaaaacaggagaatcaatatcttaaccctgtttttgagagatgaatgggtaggtcaacattgcttggctatttgtccttccatttgggacagattaccactgcactttcccctcaatctctagaatcatggcttatagaaaacaattttgtactgaattactaaatgcatcaaaactttattagacttattatcaaagagcatgctcagatgtatctattataaatagtaataaaaatataaaaacctaaaaacaatattataaataacagagaaaagctatgcactgttatgaaagcctttcatatttagggatatcaggtaaggtttcccttggtggggaagatgaagagcaaaccaaaataagagtaagagctggctgggtgtggtggcttacgcctgtaatccc

SEQ ID NO: 13612 - DNA, 620 bp, Homo sapiens
aggctatgaattcaagaccatcctgagcaacaaagcaagactccatctctatttcaaataatttttaaaaggcacattctaataaattctactgccaccaaagcaaaacaaaacaaaataaaaacaataaagagaaattatctggaagctgagtatgaaatgtggtatcaggattcttcaattcattccaattttctgaaatccattagatacagtgcaaccaaactatgctcagtggccactgggacagatagaaaattctataactgatacattcggggaggagccaagatggccgaataggaacagctccggtctacagctcccagcgtgaccgacgcagaagaccggtgatttctgcatttccatctgagacctgcagctgagggtcctgtctgttagaaggaaaactaacaaacagaaaggacatccacaccaaaaacccatctgtacatcaccatcatcacagaccaaaagtagataaaaccacaaagatggggaaaaaacagaacagaaaaactggaagctccaaaaatcagagtgcctctcctcctccaaaggaacgcagctcctcaccagcaacagaacaaagctggatggagaatgactttgacgagctg

SEQ ID NO: 13613 - DNA, 658 bp, Homo sapiens
atctggacttttcagctcaatatacatgataaataggcaggctttaggcctggctatccatttttggccactttatcactggctaccagcatgtgaacaagtcttgcaggaatagcataagattatggcacacattgattttcagcttttgactgtgttttcaataatcagatataggtgaaactgtttaagtacaagatagaggcccaatttgacagactttgaaccccaaggtcattttaagagtcagggacggaatggtcatttgatagatgggataaatatatcctgggggataaaacaaagctgtctttgatcctcctctttttagtttgttcctgatactttacatggccatcttttcatatacccattgtttacagaatcagaagggtaagatgctattctgtgcagagaatgataagaactagtacctaataactgctagaaagaagggggccgggcgcagtggttcacgcctgtaatcccagcactttgggaggctgaggcaggcagctcacctgagggtgagagttcgagaccagcctgaccaacatggagaagccccgtctctactaaaaatacaaaattagccaggtgtggtggcgcatgcctgtaatcccagctactcaggaagctgaggcaggagaatcacttg

SEQ ID NO: 13614 - DNA, 638 bp, Homo sapiens
ggcacgagggttggctctttagggcttcaccccgaagctccaccttcgctcccgtctttctggaaacaccgctttgatctcggcggtgcgggacagacgctagtgtgagcccccatggcagatacgaccccgaacggcccccaggggcgggcgctgtgcaattcatgatgaccaataaactggacacggcaatgtggctttctcgcttgttcacagtttactgctctgctctgtttgttctgcctcttcttgggttgcatgaagcagcaagcttttaccaacgtgctttgctggcaaatgctcttaccagtgctctgaggctgcatcaaagattaccacacttccagttaagcagagcattcctggcccaggctttgttagaggacagctgccactacctgttgtattcactcatctttgtaaattcctatccagttacaatgagtatcttcccagtcttgttattctctttgcttcatgctgccacatatacgaaaaaggtccttgacgcaaggggctcaaatagtttacctctgctgagatctgtcttggacaaattaagtgctaatcaacaaaatattctgaaattcattgcttgcaatgaaatattcctgatgcctgcgacagtttttatgctt

SEQ ID NO: 13615 - DNA, 480 bp, Homo sapiens
ggcacgagcagactcctcaatctgagtgagagacaagtcaaaatctggtttcagaaccggcggatgaaaatgaagaaaatgaataaggagcagggcaaagagtaaagattaaagattacccccagtcctccctagctcttccccatctcactcttagttatgtgacgactgcaaagccagtgctgtctgggatgtattcaagtgaatggggaagggagtctctcttccaagtcctttatctgcacctagaacctccctcctttcctttgcccttacctgtctctctcttctctctaggtgtcaggagaaagttttgttgatttagaagatagaaatagttggttcctaagaatgtgatgggccacaaggaaagagagaccccagtcaagctcctagtatgcccctgtatttttctgggaagtcctagcccctcacttccagcttgcctgtttcttctctacacccacccaaaagtcaccc

SEQ ID NO: 13616 - DNA, 407 bp, Homo sapiens
tagcgcagccccccggagtccttgttctccttaagagggtctcgctctgcaaagcattggcgccatggcttttcctttgcatgggtgtgcacaccgagagacaggcagcttaggaaaaacaacataaggaagacttaaaaggatgcactgatttacgacgttttttgatgttagccatttttttggaaattgttttttaaagcaaaagttttttaaaaacatggtttatagtttttcacttacatatactattgtaaatacttagcagagtcttaagttactgtataaaacatttcattgtgtttgaagacatacttatgggtcttgaggtctgggtcctaatacttttaaatagtgtatttattatgtaaactgaggagtgccatttaaagtgtgaggattgcctg

SEQ ID NO: 13617 - DNA, 58 bp, Homo sapiens
aaaattctgggattacaggtgtgagccactgtgcccaacaagagtgaaacactggctc

SEQ ID NO: 13618 - DNA, 547 bp, Homo sapiens
agatttgcttagattgttgtactgctgccatttttattggtgtttgattattggaatggtgccatattgtcactccttctacttgctttaaaaagcagagttagatttttgcacattaaaaaattcagtattaattaaacattacttattctaccctcttttttggcaaggaggacaaatacgcaatgttggaaaaccttggatggatatcttctctttaaaaaaatgtaaagataatttggtcttgagggtttaaacggttgataatgcctctacaacaacaagaaaaaagataaaatactaggatagaatcatggtgggcacagtggcttctcaggaggctgaggagggaggtttgcttgagtccaggagttggagaccagcccaggcaacatagcgtaaaccctatctctaaaacaatttttagccaggtgcggtggctcacgcctgtaatcccagcactctgggaggccgaggcgggtggatcatgaggtcaggagatcgagaccatcctgcctaacaaggtgaaaccccgtctctactaaaa

SEQ ID NO: 13619 - DNA, 410 bp, Homo sapiens
gcagcagcagcagcggcgtggtcagagcgagcttcggagaagcagtggtgggttccatgtgatggtggagtaggaggcaggtctccgcggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttccttatccctgcagctgtgtttgaacaggaaagaaaaaagaagaaaaaaaacctccatacgagagtgggtctaaaggaacttcccaaacctccatgattttgcaggaaacaagataaagctg

SEQ ID NO: 13620 - DNA, 548 bp, Homo sapiens
cgttctgtcgatttttggtcattattgtctaaacaatacagcttaacaactgttttcatagtatttccattatattaggtattataagtctagagatgacttaaagtatatgagaggctgtccataggttattatgcaaacactacgccattttctatcagggatttgaacatttgcagattttggtatccataggatgtcctggaaccagtcccccactggtactgagggacagctatacttaaagactaatatatatgctctgttttcctttaaagtacttgactctacacatttcctatagctttgaagacttgtcttccttgaagcagactaaaagggggacagatgggaggatgggaagaaccacacttccataatcttaaaattattccttccttgctatgctgacaaagtgagaaaacaaatataaattatcttaaagcccagcatttaagacacaagttggtaattacctaggcttgaaactttctaatttcactggtttttttgtttgcttgctctttatttttctctggcttaaaatc

SEQ ID NO: 13621 - DNA, 414 bp, Homo sapiens
gaaagggacctggacagccatggggtggccgggatgagccccttcctctctgtgccttggtttccactgtgggataagggggccttagcatcagcgctcagagctgtggagccaggattcctgatcgggcgctgtctctgccaggccagggcacttggacaccacgctgcaggaggctggtctcgcccaagcctctgtgggaagggccgccaggctgagtggagggccagccaccagctacggtgtcttccttcgcaggtctgtccccccaggcagaaggattccagcccagggatcccccatcccaccctgactgcatcctgagaaggggggacgccacttcgggaaggttgttggggcagcacaggccctggggccctgctctgtgaccttgggcggccccctctgtctctc

SEQ ID NO: 13622 - DNA, 546 bp, Homo sapiens
gagccaccgtgcctggcctcaccattgttaaaattatggaaatcgtgtttgcaaagcaggttggcctgtttggaaaagggtgtcataatttctcaggtaactccaaaaagagaaagctacgaaaattaccttaatacattcattacagtctcagtataagattatagcttcctctcccaaagcgtaaccacaacctgacgcaggatgagttggtttgaaaataccgcatacaatatcctcttgagtagaatcataatttagaactctaaaaatgaccggaaacaaaactgtccaagtttgtttaacgtaatgtgtttcaacttatttgactagaaaacccttcattcgtgcaacacttataaatatcccatggcaaatctagttttctacgaataatgaacgaaacatttataatttaaaactaaaattgtcttctaagcagagatctacgtatcaataaaatgaagaaataaaatttccatactgttttcttcccaatacaaggattagaaggaaagggaaaagagtaacagcgagaatcaatag

SEQ ID NO: 13623 - DNA, 582 bp, Homo sapiens
tttctcagaacataatccagttgttaagtgatgcatgaccctactcaatgtgctgaatacctcactccaaaccatttcagaaaattcagatattatcaaccctcattgcactgccttccattagaaacatgggaagttgttttggaaaagatgtacctgcccctcaaccaggcccaggcgcctgctgagcctacgacagaagttgctacccctaccccaggtgaaagtacagcaggacactctttccaagtttatcatgagaaactaagcaaaccaccatccgatacccaacccaggcccctgttctacatagaagacagataggaatattcactcagattgataagaaaagcatcctgcacatctcaggatggtcaaacctccatgattgctatgactcttgaatgacaccttcccccggagaaacagacaagaggaaatggattgaaattgatgataggccgggcatggtggctcacgcctgtaatcccagcactttgggaggcagaggcaggaggaggatcacttgaggtcaggagttcaagatcaccctggccaacattgcaaaaccccatctctact

SEQ ID NO: 13624 - DNA, 109 bp, Homo sapiens
ggattattgacaacaacagaattcaaaacccttgaaaaagaaaatgatgtgtatctatattttaaccacaaatacacaaacacacttatagtaactacaaataacatct

SEQ ID NO: 13625 - DNA, 292 bp, Homo sapiens
gatctcactcccgccacagcttgggatcggtctctgctgttttacgtcctccacctcgggagcccccggtgactgtcacagcctcttgccctgtgatctgcaggttctgggagacgcacagctaagatgccaggacatcctggaagctgggaaaagatggagtttcactcttgttgcccaggctggagtgcattatcccaatctcggcttactacaacctccgcctcccaggttcaagtgattctcctacctcagcctcctgagtagctgggattacaagcacctgccacca

SEQ ID NO: 13626 - DNA, 519 bp, Homo sapiens
ggcacgagctcagtatgtctctttcaactctagtttttgaggtggggacacaggaggtccagtgggacacagccactccccaaagagtaaggagcttccatgcttcattccctggcataaaaagtgctcaaacacaccagagggggcaggcaccagccagggtatgatggctactacccttttctggagaaccatagacttcccttactacagggacttgcatgtcctaaagcactggctgaaggaagccaagaggatcactgctgctccttttttctagaggaaatgtttgtctacgtggtaagatatgacctagcccttttaggtaagcgaactggtatgttagtaacgtgtacaaagttaaggttcttgtggtttacccatctgaaatatgtttccatcacacaatttgttacttcactgaatttcttcaaaaccattgcagaagtgaggtcatccttgaaaagtggcagaaaaagaaaatagcagagatgggtccagtgcagtggcttgccactc

SEQ ID NO: 13627 - DNA, 592 bp, Homo sapiens
ggcacgagacaggcaccaagatgtccaaccgagtggtctgccgagaagccagtcacgccgggagctggtacacagcctcaggaccgcagctgaatgcacagctagaaggttggctttcacaagtacagtctacaaaaagacctgctagagccattattgccccccatgcaggatatacgtactgtgggtcttgtgctgcccatgcttataaacaagtggatccgtctattacccggagaattttcatccttgggccttctcatcatgtgcccctctctcgatgtgcactttccagtgtggatatatataggacacctctgtatgaccttcgtattgaccaaaagatttacggagaactgtggaagacaggaatgtttgaacgcatgtctctgcagacagatgaagatgaacacagtattgaaatgcatttgccttatacagctaaagccatggaaagccataaggatgagtttaccattattcctgtactggttggagctctgagtgagtcaaaagaacaggaattcggaaaactcttcagtaaatatctagcggatcctagtaatctctttgtggtttcttctgatttctg

SEQ ID NO: 13628 - DNA, 303 bp, Homo sapiens
ttttccttcccaaatcccactaaggctattttttttaaatccaggttctaggcctggttttgtcatgaccttaatttacccttcacctaatcacctttgactcagtttcttcatctataaactgaggggcttggcctcactgagttctaatgtcctttatacatttaatcttctatgagtctaagatgcaatttctctccatatgttgaattataagcctactatgtgggtataaaattccttcaatttcccacaacttatttgccatgaaaataacaaactgtgtagacttttaaatgtttt

SEQ ID NO: 13629 - DNA, 265 bp, Homo sapiens
acgacagaggcagggaaacagggcttgaaagaaagaaggatgggggaaaagaaaagagcccagcatcaaagagaagctggttttgcctggagtggccaagtctacctgacacaggcacaatctctgatctcatccacatggccaggagctggaagtactaaaattagaatccaaagtgttctaggctgggcacggtggctcacgcctgtaataccagcattttgggaggctgaggagggtagatcacctgaggtcagaccagcct

SEQ ID NO: 13630 - DNA, 294 bp, Homo sapiens
gggtaacctggagacattcagaaaatatctgtggaactcctgcattttgtgaggcactgcccagggcattggagagagagatgcctttgtggtggtcctaaaagagttcacagtctggccaggagacattgtacaaacagactataaatggctgtgcttcttttttttctaaagaatgttcagcgggagcacttgggacctacctgtgagagctgaggaaggcttcacagaagaggtcttgcttaagaggaaacatttggggccaggtgcagtggctaattttttgtattttct

SEQ ID NO: 13631 - DNA, 529 bp, Homo sapiens
  misc_feature 373: n = A,T,C or G
taaactgaaaaatgagtctaaatgcagccactttgctattttagttcttcataagactggaagcaaagcaattttactgaaatgttatcagtgaaactactcactctacaatgaaacatttgtgtttacttttgtgtttagttattttgtgtttaatatgtgtcaaatctttatccaaacagaaatggtataaagagatgagtaagacagtctgtggctcagggctactttgttgtaaaaacccagtgacaccattctgactgtggtcctactgtttattctctatctagcagcaagatctttggaagacatgttaggtaattatcttatcactctactgttcacaatcctccaagatttccacatcacttanaattaaatctgggccgggcgcggtggctcacgcctgtaatcccagcactttgggaggccaagacgggcggatcacgaggtcaggagatcgagaccatcctggctaacacggtgaaacccccacctctactaaaaatacaaaaaattagccgggcgt

SEQ ID NO: 13632 - DNA, 297 bp, Homo sapiens
cagctgatgtgggtaaagctggagctgaaagggaattccgaggcctcggtgactgcctggttaaaatctacaaatctgatgggattaagggcctgtaccaaggctttaacgtgtctgtgcagggtattatcatctaccgagccgcctacttcggtatctatgacactgcaaagggaatgcttccggatcccaagaacactcacatcgtcatcagctggatgatcgcacagactgtcactgctgttgccgggttgacttcctatccatttgacaccgttcgccgccgcatgatgatgc

SEQ ID NO: 13633 - DNA, 206 bp, Homo sapiens
ggtaatctgatctaccacctagcacgagataaaaatgtgggagccatcggcatggagagagcatttaaatgcaggagagtggacagaatgccctaaggagcccgtggagagagaagaacaggcagtgtgaatgatgtgtgtgctgtgtgtgtgtgtgtgtgtgtgtgtgtgtgtgtgtctgtgtgtctgtgtgtgtagtgttctct

SEQ ID NO: 13634 - DNA, 141 bp, Homo sapiens
gtaaatttaacagacccaagagattatgaaaaggacatgtttttatattatgttttggagccagtagtacttatgataaagacagctaaaagctgcataaaagtcagtataacatgaatcctaagagtttgtcacagctta

SEQ ID NO: 13635 - DNA, 90 bp, Homo sapiens
ctcttccccaattccggcaggttccatgcgctccaaactttgcttatgccggtccttcttcctgaaatatcctttcctccttgtctaact

SEQ ID NO: 13636 - DNA, 92 bp, Homo sapiens
taatggttttgcaagtatgttgaccatattcccaaaccttcagataatttacaagaatacaggcatctgggccgggctcggtggctcacggc

SEQ ID NO: 13637 - DNA, 527 bp, Homo sapiens; identical to SEQ ID NO: 8402

SEQ ID NO: 13638 - DNA, 571 bp, Homo sapiens; identical to SEQ ID NO: 8404

SEQ ID NO: 13639 - DNA, 635 bp, Homo sapiens; identical to SEQ ID NO: 8406

SEQ ID NO: 13640 - DNA, 363 bp, Homo sapiens; identical to SEQ ID NO: 8408
  misc_feature 265, 266: n = A,T,C or G

SEQ ID NO: 13641 - DNA, 524 bp, Homo sapiens
ggcacgagccacttctcttcccaactcctcaatagctttctcttttgctcagattaaaatataaatactttgataggtcacagaagtgtatataatcctacagaagtacctttatagtctcatttctacctcacttattctacttcagccacattgatgtatcaggctattctaaaacatgccaagcacatttgcacctcaaggcttttgcgttactacccctatgcctgtaatgttcccccatatgtaaattagatcacaaaactcaatgaagaggaaatttccacatttgtttataacatgttatgtacacagatgcctgtattaatagaaaaaacatctagaagaaatatcagaatgtcaacagtggttatatctaggtagacattttatttatatttgtcagtatttttggtatttttgccaaaagcaaaaattatttctgccctcaggaaacatttattcatttttatagaaagattaaaacagctcccttccttggcttcttcctttatcctctttct

SEQ ID NO: 13642 - DNA, 462 bp, Homo sapiens
tatttacttcccttatctttgggatctgacactaactctgcaacttactgtttctgtaccccattttcttacctaaaaggaggttaataatatgactcatctcacaaacttgttgcgaagactgaataagataaagcgtgcaaagtcttaagaagaagacatggcatttagtaactaataaaaaatgtcacctctctcagtatcattattaccttagaaaaagtccttctcattttcatcagaggccaggcacatagttagggttcaaaatgcagttgacaaactgactgaattagcatagtctttaaaaactggaccctggaaccatatcccctgtttgtccttccctgccccatgggtaagcaaatatctccactgcctgggctcaggagacacccatgtgtaaagtatttctcagataactactcatgacccggtgacacatcaagagcaaatatattt

SEQ ID NO: 13643 - DNA, 223 bp, Homo sapiens
ggcacgagagatagagagagagagagagagagagagagagagagagagagagagagagagagagagagagagagagagagagagagagagcgccagcacactctcttgggggagacccccctctctctcccctctctgtggggggcgcgtgtgtttacacagaccccccctctctctgtgtgatatattttttcacacagagtgagagctctctctcttggtg

SEQ ID NO: 13644 - DNA, 545 bp, Homo sapiens
ggcacgaggttaccttttgatcttaaggaactgttttgattgggtcacttccttgcctaaaattccattgattgttcattgttaattctaaaatagagttcaaatttaaaggcatgtaagttcccctgtaacggatttcctctactcccccttccgctgtaatctcccatttttttactgaaatgcttcagtgagcatgggtctttagaggtcttgatatacaattttcctgaagcaggaataccttgctttcctctactagtttaccacaattacagctctcttttaagcctcagaaaaaaatctcacttccgtcttgaagtcttaatccacgctttttatatccatgtgcctactccttctctgaaatctcctatggtttatctttttattcatttaatatcccacgaattgattttattatatattttttatggttgcatgtggtctttctagttatagcagtatacacatacatgcataaatacatatacacctatgtaaatgtgtgttgggagtatgtattcacacacatacatataccc

SEQ ID NO: 13645 - DNA, 389 bp, Homo sapiens
cgttgctgtcggtttcgtacgtagcagagcagctccctcgctgcgatctattgaaagtcagccctcgacacaagggtttgtcttttgattttttttttcctaattgtgtgaacctttctgaaacagaaaggaactttaaaagtgtggaagggaaagcgaattgagctcattaacacatggaatgtaattatgcacaaatgtattcattacagtatttcagctgttggaatgatatagacacagttaattccaaagcataaagaaacaattaccctcaaagtataaatacaatactaatcacatggttcagttaacaagaaccatatatgagttatacttgaatcaaaagtgtaggcagggactgggcacagtggctcacacctgtaatc

SEQ ID NO: 13646 - DNA, 679 bp, Homo sapiens
ggcacgagcacataactgagctcaagctcttgccaaacaccaacaagcaagatggttgcaacctggcaacattgaatccaccacccttgggctccctctggaagccccagcaccggggggcttttgggcacagggtcagtggtagccatcttagacactgacatttggctttgtcgtcaatttcatcaccctccttgaggttactgtgcagtttcaaccagcattttatcctagtgaggtcattatcaggagttgccatatcatctctccagtacctaacatttctcatccacttcaaaagctgttctgactgccagctggctgatctaagctcctgaggaatgtctcctctcaaaggaatttttccctccaaaggccccctgaagtcctagttggcattggcctggcacatgctttatgttaggcctcccgttgggatggctgagaatcatgaaagacagatcctccgctagcctctgtgggtcaagtttctggacaccaagtctctgggaactagtgtttgattttaaatggcatgtggcccttccttgtttcagtgacttagaaaagtaaaagccatttaaaaaagttagcaagattttttatcgacttcccaactgggcttccagccttgttgaatgaaatcatctatctctgattgggcgcaacgaactgcatt

SEQ ID NO: 13647 - DNA, 524 bp, Homo sapiens
gctctttctttctgctctgaagccgtggatacagaaatctctgcaagcaagtggctccagagcatattgcaggacaagcctgtaacgaatagttaaattcacggcatctggattcctaatactttttcgaaatggcaggtgtgagtgcctgtataaaatattctatgtttaccttcaacttcttgttctggctatgtggcatcttgatcctagcattagcactatgggtgcgagtgatcaatgactctcaagcaattcttggttctgaagatgtaggctctagctcctacgttgctgtggacatattgattgctgtaggtgccatcatcatgattctgggcttcctgggatgctgcggcgctataaaagaaagtcgctgcatgcttctgttgtttttcataggcttgcttctgatcctgctcctgcatgtggcgacaggtatcctacgagctgctttcaaatctaagtctgatcgcattgtgaatgacactctctatgaatacacaaagcttttgagcgccaca

SEQ ID NO: 13648 - DNA, 623 bp, Homo sapiens
ggcacgagggacaagagaatacttgttgttgcatgatatctcagaatcggaatttctaactgaagctgaaatcatttgtgatgttgtatgcctggtatatgatgtcagcaatcccaaatcctttgaatactgtgccaggatttttaagcaacactttatggacagcagaataccttgcttaatcgtagctgcaaagtcagacctgcatgaagttaaacaagaatacagtatttcacctactgatttctgcaggaaacacaaaatgcctccaccacaagccttcacttgcaatactgctgatgcccccagtaaggatatctttgttaaattgacaacaatggccatgtatccagaggatcattacagagacagactctcccgagacatgggccacactgatagaatagagaatttgagaaaaatctgggtctttctaaaaactgctttgcacgtgacacaagctgacctcaagagctccacgttttggcttcgagcaagttttggtgctactgtttttgcagttttgggctttgctatgtacaaagcattattgaaacagcgatgatataaaaagaaatactgtccctaccaaaaacaaatacttttatgtacattctgaatgc

SEQ ID NO: 13649 - DNA, 210 bp, Homo sapiens
aaatctgtcatgcagcagggccctgaatcttccacccataggtacctttcatttccttaactttagagttcatcttagtcagtaaaggggcatctatttttgtctctcagatcacagttgaaaatactttcttctggggaatgagatggaattgggcaagggattacaggagtactataattttaaaattgttattacagtacttcacta

SEQ ID NO: 13650 - DNA, 243 bp, Homo sapiens
tcgccatctggacaagagaagaaacaagcctgagagaaaggagtggctatcagcatcagttcctgcttgtcgaataaagatctgaaagaagctcattggtttcagcaacaaggaaacattaataacatttacgaaaatagttttgatggggagataaagatagaaagacagtctttggtgttgccaactgatatggtttggctctttgtccccatccaaatctcacattgaattgtaatcccc

SEQ ID NO: 13651 - DNA, 533 bp, Homo sapiens
tcacatttctgcccatagggttcttccctcccaccccaacaggtccctaggtatcctgtaattttaagaaacggtttgcaaacctgagtgttcctcagacagagtggcctgtaatgagccagcccaagaggctgacacccaggtgcctccaatctcatcgtgtgtggtgcctaacagcactatctgggtaaatccagaataggttactcatctgtttacatagctaaggtagaagtggacaataagacctcaagtataaggatgacagtgttaggattattagatgcatctactgatagcccgtaaaacgtgtaagacagaagcagaaaacaaacttacttgcacacactagtattaatattgtgacagctaacagccagttgtttctggcttttaagaagttggggctggacgctgtggctcatgcctgcaatcccagcactttgggaggccgaggcaggtagatcactcaaggtcaggaaatcgacaccagcctggccaacatggcgaaaccccacctctactaaaatacc

SEQ ID NO: 13652 - DNA, 375 bp, Homo sapiens
ctaatttttgagaacagcaagccctatttgaccactctcttcagcctgtgtgttcctgctgttttgaagtaatcaaatgctgtgcatggtattttacctgagctgcaacctgttatggacttgaacttctgtttaagttgaaagcaagagtccctgagtataaaggaaaaacagcaaaacaaaaagcaaacaaaaaaaaactgcaaaagtctaaaatacccattggtgatgttttttaaaaaaatcttgctttcagctttcaggagttaatattctttgttttaatttgataattggatatggttgatttatattgggtttaaactgtggagctttcatgtttactgtaatttagtcttaaaatattttttactt

SEQ ID NO: 13653 - DNA, 173 bp, Homo sapiens
ccaaacttggaggtggccgcttccagaccatggaggagaagaaagcattcatgggaccactgaagaaagaccgaattgcaaaggaagaaggagcttaatgccaggaacagattttgcagttggtggggtctcaataaaagtttgtttcagtggaaaataacttttattgagac

SEQ ID NO: 13654 - DNA, 520 bp, Homo sapiens
ggcacgagggaggctctctgttaaagatgcttttgcccccttaatacagcaatgacagcactgaccgaagaggcagccgtgactgtaacacctccaatcacagcccagcaagctgacaacatagaaggacccatagccttgaagttctcacacctttgcctggaagatcataacagttactgcatcaacggtgcttgtgcattccaccatgagctagacaaagccatctgcaggtgtctaaaattgaaatcgccttacaatgtctgttctggagaaagacgaccactgtgaggcctttgtgaagaattttcatcaaggcatctgtagagatcagtgagcccaaaattaaagttttcagatgaaacaacaaaacttgtcaagctgactagactcgaaaataatgaaagttgggatcacaatgaaatgagaagataaaattcagcgttggcctttaaactttgccatccttaaggagtgatggaagccaagtgaacaagcctcagtgacacaagtcaaattc

SEQ ID NO: 13655 - DNA, 94 bp, Homo sapiens
ttcgataggtagccaacgcattgaatttccttcctttacattcatggttctactccctgatctcactatgattacgttgggcacaaccttcctt

SEQ ID NO: 13656 - DNA, 69 bp, Homo sapiens
gaaatggacataaacccgggtgtgaaaagccagggaatgaagcccgcgggagcggggaatctgggattc

SEQ ID NO: 13657 - DNA, 68 bp, Homo sapiens
gttgttgaaaacaactctgtaactgaattttctgaggagaaaaacagaactgaaaattacaacaggca

SEQ ID NO: 13658 - DNA, 445 bp, Homo sapiens
aaacatctattctgatgtcagaggactatctcagaaccagcaaatacctcaaaattctgttacgcctaggagaggaaggagaaagaaagaagttaatcaggacatactagaaaacaccagttctgtggaacaagaattacagatcactacaggtagggaatcaaaaagattaaaatcatctcagctgttggaaccagcagttgaagaaactactaaaaaagaagttaaggtttcatctgttacaaaaaggactcctagaagaattaaaagatctgtagaaaatcaggaaagtgttgaaattataaatgatctaaaagttagtacggtaacaagtcctagcagaatgatcagaaaattgagaagtactaatttagatgcttctgaaaatacaggaaataagcaagatgataaatccagtgacaagcagctgcgtattaaacatgtt

SEQ ID NO: 13659 - DNA, 236 bp, Homo sapiens
gaatatgatactttggaggggaaatgcttggcgtgtgtacaagtatgaggagaccaacttacacaacccatcaaatacttatgctcctcatagccaaggaggtattccacctcctgctggaatgtaattaaagggagaaacacactgtatgaaatatatgtctatatcatgacttgttgccaacatcttgaggcacattatttgtttccaataaaagtaatgttttttttttttaa

SEQ ID NO: 13660 - DNA, 559 bp, Homo sapiens
caccatccacccagttaacatcaggttggccttgagaatagagtccactgttcacactggggtcctagaataggagaggctgcgccagtacaggatggggccccggtgtgcccgggatccgtccggccgagaagcagcaagtccctggaggaaactgcaccagggaagatggtcagaaagaccagcctgcatggggtgtgagctgctgggccgtgctcgccaccacccgcctctctttcctctgcaggacacagaaggctctgccatgtggctgtgctctctgtggtgtctggaatattttcttccatttcctcactactgaaatctttccctttactaagaaatgcctttaaaatggaaatgtctttgaaacctgggtagcagttttaataactcccttccaccccatgtctataactagcattggggtccccaggagcacccccactcagcgattcactgggaggactcctggagctcatgcccagcaggatggccatgatttgttacagagaaagcacgcggagcatggtcagcagagcgagaaggtggaggagag

SEQ ID NO: 13661 - DNA, 573 bp, Homo sapiens
acagggtcccacactttgattttgcaaattacgcagcctgtcccatgtggagttttagatttgaattattattttattagtatttttaggctatatatcttcactctaaaaaatgcacgtgtatgtattagttttataagtgagatttacagcagtcattgaacttcttgcagagctttgctgccagtcttaactgtagggtgtggtctgtcagccaacaaacagctttttaaagaatgttgcatgttgtgtgagagggaaaaaatacgacacaaagggcctttaatcaacatgcttgcaaagccactctcacagagtagacgccttattgggtaatttctgggtcccaagccccatgctgaccacaaggatacagagagaaacagagcacagcccctgccctcaaggagtgccttgtctagttgaaatctgtttcgtaactttctaaacctcaagccactctaagaaatatgcaacccagaattcagtacacatagagataatacacacatagaaagatgaaacagtaggccgggcatggtggctcatgcatgtaatccctactttttggga

SEQ ID NO: 13662 - DNA, 393 bp, Homo sapiens
ggcacgaggagatagagagagagagagatagagagagagagagagagagagagagagagagagagagagagagagagagagagagagagagagagagagagagagagagagagggcactctcttgtataaatctcttttttgtgtttctctcttccccccccctctctttctctctcttatagagcgacaccctctctttttgtcccctctctctcgcgcccccgtgggcgctctctctctctctctccatttttcaccacactccccacacatatatatatatgagcccccccgcgcgcgcgtctctctttttttttgtctctctcgcgcgcctgtgttttgtctcgcatcttttccccactctagagtgagagcgcgcccccacacctctc

SEQ ID NO: 13663 - DNA, 96 bp, Homo sapiens
ataaagaaggtaagaaacctaggaccaaagcacccaagattcagcgtcttgttactccacgtgtcctgcagcacaaacggcggcgtattgctctga

SEQ ID NO: 13664 - DNA, 445 bp, Homo sapiens
gtcaattgggcacgagggcgcccaggccgccgcctgccaggctgtcgggcgtcatggtgccggcgcccatccaagacctggaggccctgcgcgcgctcacggcgctcttcaaagagcagcggaaccgagaaacagcacccaggactatcttccaaagagttctggatatcctaaagaaatcttctcatgctgttgagcttgcctgcagagatccatcccaagtggaaaacctggcttccagtctgcagttaataacagaatgcttcaggtgtcttcgcaatgcttgcatagagtgttctgtgaaccagaattcaatcaggaacttggatacgattggtgttgctgttgatttgattcttctgtttcgtgaactgcgagtggaacaggaatctctgttgacagcttttcgctgtggcctgcagtttttaggcaacattgcctcacg

SEQ ID NO: 13665 - DNA, 611 bp, Homo sapiens
ggcacgagctgaagtatgtctggcaaaacctagaactgcatcctagccatcactgtaccttctgccctccctgctgtctcctctgccagttacagttaaaaggttgtgggtgaggacgctgggcagagtcccaggcgtctgctgtcagctccccagcccggcctgcctgccgagccatctgggcgtcccacggtggagagtgtggtgcttgtgacgcggtggtgctgggagccatcctggtggcagatgtgggctctcactgcaagtcagtgtaagtccccagggactgtcagcagcacgtcctgctgcccctctctctgcagaagccctggtaacctgcgtttggaaaaatctctaaggatttctgaggagctgtcaggccatgtccttgtccaccctgtgtggggcacggcttcgacatggctctgctcccgtcgtgggctgagaaggagcaggtggggctgtgccttggaaaggaggccctcccgacatgcctttgtgcgaggtccctgtccatgctgtctccatcccggagccttacggcgatgggtggccacagagcctattccaagagtctggtttaaggctgggtcttcccatcttcacctctg

SEQ ID NO: 13666 - DNA, 503 bp, Homo sapiens
aaatgcttcttaaagtctggctttataaccgttaaaaatctacattgtagattgtagataaccaagtgagcattataatacaaaataattttaagtgtaataaactaaagtataatcaaagtaaatgcaggtattggatttgtggtgttgccttgccttgcatgatgctgggggaaaaagagaaaagaaatggttttctttttgtactttcattcagtgtagagggaaaaaagcatgtattgggccaccggaagacaagctaataaataggctggaagtaatattctaccagcaggaactcaacagctccagttaaatgctttgatatagtggctcctttgcagagccaaaacaagatttattaaatttccttcaaactgtttatctttaaaacaaatataaggttttaattatactgctgaagcaaatgtgaatgccaaagactacgttttgcagttttgctttcctcccaataaatattaatgtatgtaattctagagggt

SEQ ID NO: 13667 - DNA, 79 bp, Homo sapiens
tagcttttgcaaacagctctctctctccatgaacagaagcaaaaaatgacttgtttaaaacacaatcaacataactact

SEQ ID NO: 13668 - DNA, 66 bp, Homo sapiens
aacggtgtgaacccgggaggcggagcttgcaatgagccgagatcgcgccagtgagcgagactctgt

SEQ ID NO: 13669 - DNA, 465 bp, Homo sapiens
ggcacgaggcaacctctgcctcccaggttcaagtgattctcctgcctcagcttccccaatagctgggactacaggtgtgcgccaccactcccagctaatttttgtatttttagtagagacagggttttgccatgttggtcaggctggtctcggaactcctgacctcaggtgatccacccgcctctgcctcacaaagtgctgggattacaggcatgagctaccgtgcctggcctaaaccttacgcttttgaggttgagtgcaggccttgtgataactaagtgctacttttgacgagccttcaacaagctgcccagtcctctcctcagcagacgcatcaggttgtagttgcatctttacagtggtctttccttttattaaatctatagcagtgaatatagatttgattcaacttttagttacgttctctcaagaatcctaatcaactttcagttagcctcttaagaa

SEQ ID NO: 13670 - DNA, 457 bp, Homo sapiens
ggcacgagagagcgagtctctctttgttgcttaggtttgtcttgaaatcctgggttcaagcaatcctccctcctcagcctcccaaaatgctgggattacaggtgtgagccaccacacctggcctctactttcttatatttccttaaatagatttcctttctttttggattaagaaaaaataaacagaaaattaaaatttgaacatattataaaaatgaaagataattgtaaaatcttggtttggagagtgtctctctgagcccagaaatcatccagaaaaatggacagatttgactgcatcacatttaaaaactttacaatgatgaaaaatacaagtgaagctattcatacaatagattaggaccaagtatttttaacatgtattatagacaaaaaattaccatccaaaatatagaattgttacaaaaattttaaaaacatggttaaaaaatgggca

SEQ ID NO: 13671 - DNA, 193 bp, Homo sapiens
agatcaaatccactcccaaagagtaaggcagattagagaccagaaagaccttgactacttccctacttgcactgctttttcctgcattgaagccattgtaaatctgggtgtgttacatgaagtgaaaattaattctttctgcccttcagttctttatcctgataccatttaacactgtctgaattaactagac

SEQ ID NO: 13672 - DNA, 484 bp, Homo sapiens
attccgttgctgtcggtgcggcgtctgatttctcggtgctaacctggcagctgtggggcccttaggagccccccaccgagggtggacacagtccctttccttcctgcagatgcctaagcaggaggagggcttcctgcctgtttggcaaagtcccacgcagaggccaaagatgaggcctgactcggctcctccctccacatcagccaaggcatcataagttgggccagggcggggtcttccctgctcgattttggacgaagcctaagtagaccccctatgccctgccccagacctggctctttcctaaccccctcaacggtgggaggaactggcagagggtgcgcctggccacagcctccccgcatctaaaggccccttcatttcttgaccaaaggtgctacgataacctgccgtggaaacttccacttgtgcgtctgccccactcgctgtgtttgtccgtgggttcatacatgcattgggtgct

SEQ ID NO: 13673 - DNA, 416 bp, Homo sapiens
ggcacgagccgacgcggcgaaggagcgcgccatggagcatgtgacagagggctcctgggagtcgctgcctgtgccgctgcacccgcaggtgctgggcgcgctgcgggagctgggcttcccgtacatgacgccggtgcagtccgcaaccatccctctgttcatgcgaaacaaagatgtcgctgcagaagcggtcacaggtagtggcaaaacactcgcttttgtcatccccatcctggaaattcttctgagaagagaagagaagttaaaaaagagtcaggttggagccataatcatcacccccactcgagagctggccattcaaatagacgagccagattctttggatcggaggcaggaatcctggagaagatgttgagaggtttaagcaacaaggtgggaacatcattgtggccact

SEQ ID NO: 13674 - DNA, 335 bp, Homo sapiens
atgatgggttgatgggtgcagcaaaccaccatggcacatgtatacctctgtaacgaacctgcacgttctgcacaggtatcccagaacttaaagtaaaataaataaataataataataactgaacacatatgtgttaattgaacacatatgtgccaggcactcttccgtgtgctacatatcgagtaatccatttaatcctcccagcatcctttagaatgggtgctcttgctatagttaccttacagaggagaaaacagagacacagaactgttaagagccttgactcagggccttacacctattaattggggaatatggaatgtcaggaaccatgt

SEQ ID NO: 13675 - DNA, 619 bp, Homo sapiens
aggcaagaaacatagaccagtaatttacaaatgggtaaaccacatggttaatcaactcagggagatgcacatcttcacagtaaccagggaaatacaaagaagaactacaatgaggttttattttatgtttgtcaggttggcaaatacttaaaaatgtggctgtatccagagttcttgaggatatgaacacctataccctgattcttggagctattttggaaaataatttggaataaaaagtaaatatgaagatgagaatatcccataataataattatttctagttatatatcctaaaggaattcttgaacattaaatattttgtaaatattgtttgcaatagtaaataaaaacaacataaaaggccagccgacaagagtggaaaataagttgagctatggttatacaattgttataaaatatttgaaaataaaacaattagaagtatatttatgaaacatgagtgaatttcaaaatcagaacattgagtagaaaatgcaagtaagaggagcatttaatgcatgatgtcacttttgtaaagtttaagaacacagatatcaataaaatattctaagagttgagaaaggagagtagaattagaaaatgacataagcttgac

SEQ ID NO: 13676 - DNA, 69 bp, Homo sapiens
  misc_feature 69: n = A,T,C or G
cagagtgagactccatctcactctccctagctctgactgctggcatgcacctgtagttccagttattcn

SEQ ID NO: 13677 - DNA, 358 bp, Homo sapiens
atctccttcaaatatctggtttattattaaatatatgtgaaactagtggacaatttgggagaggtcaagagaatgaaacagatatgttcactattacttatgaaaattattttatgaatagccaagcatatatatcctcttttttattgatcaaagatgctttacatctcattttaaagtaataggcttcataatttcacacagctcaatagtgtaaaaagaatgtatttcttaaaataatgtagggtcggccgggcatattggctcatgccactttgggagatcaaggcgggtggataacctgatgctaggagttcgagaccagcctggccaacgtggagaaaccccctttcaacta

SEQ ID NO: 13678 - DNA, 470 bp, Homo sapiens
tggagctggttcctctcgtctttatgacccgtgaaaagcgcaccaacacgaagacacgcgtgaaaggaccccatctcctaaccagactgacaagcaagggattttttccactcaccgtcagtgggatggttctaagcaccgaggccaacccatttcacacgattatttcacaaaaagaaactttctgtgggacgtgcctgggcgactgaaaagacagccagcaaaactgagaaccttgttcgcaaatccgtaccctctcccaaggcagcctcagaggcccgagggctgaggatccagacccgaaagccactgtaccttctgtaggatcaggctcaaggactaagggggtaaaaggtgccctttcccttcctaagcagaaaattctgtaacccaaccttatgtgtgatcatttaaaaaaaaaaaatcagctgggtacactggctcacgcctgtaatcccagcactttggga

SEQ ID NO: 13679 - DNA, 417 bp, Homo sapiens; identical to SEQ ID NO: 8636

SEQ ID NO: 13680 - DNA, 624 bp, Homo sapiens
ggcatgagccactgcgcctggcccagttttcttttttaaaagaaataaaacttaccaataaagtcagaatgtttgttagaatctttcattcctgttaactccagaagtaaccactattatgaatttggattgtatccttccagagcacaattttactatacttttacaatatgtgtggttttccatcaacaatatatagtatttttatatgcttttacatttttatataaatcttatactgtagttgtcttcttgcactcaatatttttgaattcattttgtagatgtaatcaatgatatgcatataccaaattttatttattaatttccttattgatggattaagttgctttaaaatattttgctattagaaacaatgctgtaatgaacagctttattcacatctccttgagtatacatcaagatacatcaagattatacctaggatgttgctgagtgcagtgtttcacacctgtaattctagcactttgggaggctgaggcaggtgaattgcctgggctcaggagttggagaccagcctgggcaacatggcaaaacccatctctacaaaggatagaagattagctaggcatggtggcatgtgcctgtagtccgagctactcg

SEQ ID NO: 13681 - DNA, 217 bp, Homo sapiens
cctcccgagtagctgagactacagttgggtaccacctggccaggctgatttttgtatttttagtagagatagggtttcatcatgttgtccagtctggtcttgaactcctgacctcaagcaatccgcccaccttagcctcccaaagtgctggaaatacagaagtgagccaccgcgcctggcctaataagtatagatagtatttcacttttatattcct

SEQ ID NO: 13682 - DNA, 280 bp, Homo sapiens
aaagtctctacacagtttatacctccagtattgcaaatgatgtaaagatgaaatacatagcattgggaattgtaaaaaatcatgctgacaattgaaaatagtgagaacaactgaaaaagaaaaagaagaaagctgaaaaaaatcaacatgtgataatgtgttattacagggagagattatgggcaattgcatggagatattccttaagagctggttggctttctccatcattaactatattttgatgccctacgtcacaatgaatagctgcttttttttt

SEQ ID NO: 13683 - DNA, 537 bp, Homo sapiens
ggcacgagggaggcagctcccaggagtcgaaggcccccaggggcaggtccaacccagtctctgctcagcttggccttaacggcggcacccccagatctccatccagttcctggtgtacaggcgcagcaccgccgcctcggagcttgagcccctcctccccagctgaccagaaccaggctgagcgcaggaggacaggcaccaccggatgccacaccaggcaggaggaggtgtggacagtgatggtacggcggccctgcatcagcctgcgggtggcctctggatcctccgtggaccgaaccgtccccccaggaacacaccttcaggtagaccccgaagcctcaaggccggggctggagcggagaccccagggcctctcaggagacagtgaggctgcccctcctaccacctacctcattctgcctactcaccccaggggccacagccacagcctgctggactcaggactgtcctgtcaactccagacaactgaataaacaggccgggtacagtggctcgcacctgtaatcctagcacttt

SEQ ID NO: 13684 - DNA, 627 bp, Homo sapiens
ggcacgaggctgtactgcccttcaggacaagcttcttgaagaagaaaagaaacagatggaacatgtacagagagttctacagagattgaaactggaaaaggacaactggcttttagcaaaatctaccaaaaatgagaccatcacaaaatttctacagctgtgtatatttcctctttgtattttttcagcaattgatgctgtttactgtgctcgttttgttgaattggtacatcaacagaaaactccaaatttttccacacttctttgctatgatcgagttttctctgacataatttacacagttgcaagctgtactgaaaatgaagccagtcgatacggaaggtttctttgctgcatgttagagactgtgaccaggtggcatagtgatagagccacatatgaaaaggaatgtggaaactatccaggattccttaccatattacgggcaactggatttgatggtggaaataaggctgatcaattagactatgaaaattttcgacatgttgtacataaatggcattacaaactaaccaaggcatcggtacattgccttgaaacaggcgaatatactcacatcaggaatatcttgattgtgctaacaaaaatacttccttggtacccaaa

SEQ ID NO: 13685 - DNA, 478 bp, Homo sapiens
ggcacgagcggaaacaaagcccagggaagatgtctccatgaccagttgtgaaccctttgggaaagaagggatactgataaaaattcctgctgttatttcccacagaacagagtctcacgttaaaccagggaggctcaccgtccttgtgtctgggttggaaatacatgactccagttctttgctcatgcacaggtttgaaagagaagacgtggacgacatcaaggtccactcaccttacgaaattagcatccgccagcggtttattggaaagccagacatggcctatcgtttgatatctgccaagatgccagaggttatccccattttagaagtgcagttcagcaagaagatggagctgttagaagatgcattggtgctcagaagcgcaagaacctcttcccccgcagagaagagctgctcagtctggcatgcagcatctgggctgatgggccgtaccctgcaccgtgagccacccgca

SEQ ID NO: 13686 - DNA, 550 bp, Homo sapiens
ggcacgaggtggcgcgtgcctgtagtctcagcctcccaaagtgctgctgggattacaggcgtgagccaccactcccggctaagttagtatttctttaatcttaatgctttaaactaagccacttggatcctgaataatttaaatcttgagctacattggtaagtaataaattatttaaggccaggaattcctgtagttttcatggagtctgtagctttattaaaaaataaatcactgccaggcttcattcttccatatgatcctctaaaaatggacacttcctctgaatgctgtatctcatggcacctggtccaactagaaatggtcaaggaattcatttggctccttgatacatcagtcctcaatattactttctaggtattttatggccagattgcttatatgagtggtcttttggtttggtagtaggtttttatttttaatttctgtactaatgaaattcctgactttaatttctgaaaaccaaaaactctccaagtgtatttatttatattttttttaatagagacgaggtcttgctatgttgccc

SEQ ID NO: 13687 - DNA, 561 bp, Homo sapiens
ggcacgagctcaagcagaccacctccttctatgccctgctcacctgcggtatcatcatcgggggcttctggcttggtgtggaccaggagggggcagaaggcaccctgtcgtggctgggcaccgtcttcggcgtgctggctagcctctgtgtctcgctcaacgccatctacaccacgaaggtgctcccggcggtggacggcagcatctggcgcctgactttctacaacaacgtcaacgcctgcgtcctcttcctgcccctgctcctgctgctcggggagcttcaggccctgcgtgactttgcccagctgggcagtgcccacttctgggggatgatgacgctgggcggcctgtttggctttgccatcggctacgtgacaggactgcagatcaagttcaccagtccgctgacccacaatgtgtcgggcacggccaaggcctgtgcccagacagtgctggccgtgctctactacgaggagaccaagagcttcctctggtggacgagcaacatgatggtgctgggcggctcctccgcctacacctgggtcaggggctgggagatga

SEQ ID NO: 13688 - DNA, 580 bp, Homo sapiens
ggcacgagagcacccatcagtacccagggtatccagccggcccccattgggaccccagggatacagcctgcaccacttggcacacagggaattcactcagcaaccccaatcaacacacaagggcttcagcctgcacctatgggtactcagcagcctcagcctgaaggaaagacttcagcagtggtgttggcagatggagccacaattgtggccaaccctattagcaatccattcagtgctgctccagcagcaacaaccgtggtgcagacccacagccagagtgctagcaccaacgctcccgcccagggctcatcgccacggccaagcatactccggaagaaacctgccacagatggaatggcagttcggaaaaccctcattcctcctcagcctcctgatgttgctagtcctcgagtggaaagctctatgcggagtacgtctgggtcacctaggcctgcaggtgccaaacccaagtctgaaatccacgtgtctatggccactccggtcactgtgtccatggagactgtatccaatcaaaataatgatcagcctaccattgccgtccctccaactgcccagc

SEQ ID NO: 13689 - DNA, 369 bp, Homo sapiens
ggcacgagacagaaggtctgacacaggaactttgagaagacgtgacagcaatcccttcaccttttgaattgtcatggagcctatcaaaagacaagaaaagtccattcgttctctcaaatgacagttacctgtaaaactagctcatgtgatgagaccacagtatcattgcaatgatagctgtatctgtctttttttttttttttttttggaacgggcttactttctttcttaaaaaagctttggttttgccccccagctggaaggcaaggggggaatttggggttaatggaaccctcgtttcccgggttaaaaaaatttttctgcccaaaccctccggagaaggggggcccattacccccccccgtttat

SEQ ID NO: 13690 - DNA, 546 bp, Homo sapiens
ggcacgagtctgatcatactcactgggtcagcaacaccctactgaccttgtccagaatcccacatcccagttgatatcagggcaatcagtttcctggctgttttccccaatatcaacccgggcttacagaagacagtcaccacagagctcctgccaggagttcactcattcgtgcatttcttccttttttttttctttttgagatggagtctcgctctgtcgcccaggctggagtgcagtggagcgatctcggctcattgcaacctccgccgcctgggttcaagcgattctcttgcctcagcctcccaggtagctgggatagcaggtgtgtgccaccacgcccagctaatttttgtatttttagtaaagatggggtttcatcatgttgcccaggctggtctcaaattcctgacctcaggtgatctgccctcagcctcccaaagtgctgggattacaggcttcagccaccacacccagcctcattcatacatttcttattgttgttgtttgagacagggtctttctctgtcacccaggatggagtgc

SEQ ID NO: 13691 - DNA, 641 bp, Homo sapiens
ggcacgagacacggggcctgaggttttactccagaaaagcagaggagtggcaaccttggcttggggtttggcagcccaggaaaggcagggaggagagctcaaagccggtttcatgtttcacccaaggtctaattgtgggagaggacaaatccagatcccctgtttgacagaattagttcacaaatgtctcttggcaaaaacatgtgacacctaaccatgataattgacttaatccaagaaagagctctgtagggcagagcaataggaaatctctctttcgttatggaaaaaaaataatccctctacatagaaactgagtgacatgtaaaaatgtgtagctaagtcagggagttacttcctaagagcctgacgctctgcttttcatcaaaaggaaaaaccagcgtgaggcagaggcgagggaggtggaggtgagtggatgatgtgctgagttagggatgtttatatgccgcaaaggtttggttggtaggcttcgcgctaagattagcctggctttgtactgaaaagggggaaggacacatagtgacacagatccttctggtctttcccaggaggtgtgacctaatgaggtttgttgtgagaataaagcaatgtggtttcacatatattatctatcataggct

SEQ ID NO: 13692 - DNA, 390 bp, Homo sapiens
ggcacgagtcccagctacaggaggctgaggcaggagaattgcttgaacccaggaggtggaggttgcagtgagttgggatctcgccactgcactctagcctgagtgacagagcgagactctgtctcaaaaaaaaataaatgaataaaaaataaaacagcaactcttgcagatttcccgaatgtattggtcccagagaacactgaaaataatgtcatgttgttaacaccagtgggagtttgggaaataattccagctctttaatacttctttcagcttcagattaagtgaaatgagtttcacatatttcaatatatgaaattttatgatgacacataaaacaggccaggggttattgaggacacatctgtgagatagtgggcaatgctactg

SEQ ID NO: 13693 - DNA, 601 bp, Homo sapiens
ggcacgagccggggcggggcggggcgaggtcctagctagctgggttagtaagcggcgcgagcgtgcgagtttctgtcgcgcccgcgtcgtcccagctccctggactaccagtattgtcgcccacgtgggcttctctttcgtccgctcaggcctcacttttctccgtaaacaccccggcacgatggagcggccccagcgttcgggagcggcccgggagcggaaagcggcagtgtcctgggagcctcgaaagccgcaggggcggcagctcgcctcggaatgacctctgacggaagaaataaaacggggcctgggacgcttgcacgaaagaacccgacaaaaaccagagcccgcactcactctcgtactggggaggtggacttcagggagggttatctggaggaggaatctctcaaagtacaacacaggagaaagacagtatcgcaatacagaaattttattttttattttattattattttcctgagaccggagtctcgctctgtcgcccaggctggagtgcagtggcgcgatctcggctcactgtaaactccgcctcccgggttcacgccattcggctgcctcaccctccacagtagctggg

SEQ ID NO: 13694 - DNA, 324 bp, Homo sapiens
cctctcctacaccccagggccttgtcatcagactccctcagctccagacctccctgtgcagtaactcccccctcaaagaattcacatccctggacagcagtggaccttttaaactataaagcccattctgctcctactttcagaagatcctaccaagtttagagaagaaggtatctaggattgaaagtacaacataagaagatattcagaatacaatagaagctgttctaagagaaaaaatgtgtagctgtatagttttaggtgcatttgtgagaataataagaaatttaaatctttttaacctctgaagattaccatttccta

SEQ ID NO: 13695 - DNA, 517 bp, Homo sapiens
ggcacgagtgaagaatggcgtgggttggttcctttcaaatgcacttgagcagcggtctccaaccacagggccacagagctggaggtgagcagcaggcgagtgaagggaaacttcatctgtatttctagcccctcccatcgcttgcatgaccacctgagctccatgtcctgtcagatcagcagcagcattagattctcacaggagcacaaactctgttgtgaagtgtgcatgcgagggatctaggttgtgtactccttatgagaatctaatgcctgatattctgttactgtctcccatcaccccagatggacagtctagttgcaggaaaacaagctcagagatcccactgagtctacgttatagtgagttgtagaatcatttcattatatattactatgtagtaataatagaaataaagtgcacaatatatgtaatgcacttgaatcatcctgaaattattccctcattcccagtctgtggaaaaattgtcttccacacattcactctgttttttggt

SEQ ID NO: 13696 - DNA, 300 bp, Homo sapiens
cggtgctggtgcggcgggggactgcggggccagcctcaggtagcagcagcagcagcagcagcagcagcagcagcagcagcagcagcagcaatgtttcacttcttcagaaagcctccggaatctaaaaagccctcagtaccagagacagaagcagatggattcgtccttttagaagcatctcagaggctctccagtgacgtgctgttaaaagtgctgaccctgggtcagaccctttgggttggcttcgtggctccacgacttactctctacccttggcagtggcgtgatctcggctcactg

SEQ ID NO: 13697 - DNA, 432 bp, Homo sapiens
ggcacgaggaatgggtaggaacaagcattagcctggtctgggttcctccagctcttaggacaagttggaacacatttgctgttctgatgattcatctttctgatcacagggatagcataactcagctttgaagaaaggcatctgcagagatcatggcagttccattttgcgttctgagtttgctcctttaggtaagggaactagaatgcagatacagttagaatcagtctctctctctctgtttgtctgtctgtctgtcactctctctctccttattgcactgatggccgggcgcggtggttcacacctgtaatcccagcactttgggaggctgaggcatgtggatcacgaggtcacgagatcgagaccatcctggccaacatggtgaaaccccgtttctactaaaagtacaaaaattagccggcgtggtgg

SEQ ID NO: 13698 - DNA, 628 bp, Homo sapiens
gcctcatcttctctgggaaccagggcagggggcaccagcgccctctgcccccctcagagggtctctcccctcgacccccaaattcccccagcatctcaatcccttgcatggggagcaaggcctcgagcccccatggtttgggctccccgctggtggcttctccaagactggagaagcggctgggaggcctggccccacagcggggcagcaggatctctgtgctgtcagccagcccagtgtctgatgtcagctatatgtttggaagcagccagtccctcctgcactccagcaactccagccatcagtcatcttccagatccttggaaagtccagccaactcttcctccagcctccacagccttggctcagtgtccctgtgtacaagacccagtgacttccaggctcccagaaaccccaccctaaccatgggccaacccagaacaccccactctccaccactggccaaagaacatgccagcagctgccccccatccatcaccaactccatggtggacatacccattgtgctgatcaacggctgcccagaaccagggtcttctccaccccagcggaccccaggacaccagaactccgttcaacctggagctgcttctcccagcaacccctg

SEQ ID NO: 13699 - DNA, 222 bp, Homo sapiens
gtagatactatgtttgtaagtctatagctaagcaacttaagccaaaaaggtctttcaactgaagctttaatcaacttattttggagatgttctcttcccttatctcatgcgtcatccctaaaataataagatacatgggatcaaatagcccttgccttttcaacacaaatcagttggaaaattatggtttgagtcctgttgctgccatggcttctgtttctc

SEQ ID NO: 13700 - DNA, 405 bp, Homo sapiens
tgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggacaaagccaaaggccccttgttagctggccatccctgccccattttttcccctggtcctttcccctgtggccacagggaagtgtggcctgaataccccaccccggctcctctgcacccagagctgggggccacctcagaagtgtcatctctctctgagcacgcattcccctgcagcagtcgaggactgagcagattgagtgat

SEQ ID NO: 13701 - DNA, 611 bp, Homo sapiens
tactgtgaatggagagcttcagctaagaggaggctctgtcccttttcagagccaaaggaaataatacaacaaaaaggaggcttctttggagacctaagtctattggatgtaaacaagacgttgtatttagggatgttctgtgtttctttcttttttgaagttgtcatcaattgctttactaagatttttaaatagtgaaaacctcctgtttagactttggtggaagatgaatcaaggaagcagggccctgtcttatgggtcacgtgtctttggtgagtgagaagacctaaactcctggccatcatctcttatccaatacttagcagttggggattaaaccatccttgccttcagttctctccaatattaccaggcccaactcagtcttcagtgattttaaacagcattgacatcatctgtaaaaccatcatctgtaaaaccatctatgacatgagttttgagaaacaataatggggaaaatatttgggaccaagctgaagcactaatcccactaagttaaagacttctttccagtccaaggcaggcctgaatcaactgtctttaaataaaattttaagtgatgctgtattatatataggaaaaaatgctta

SEQ ID NO: 13702 - DNA, 128 bp, Homo sapiens
cgggtcccagcctcgttttccagccctcactcaaaatggagtcgctctggttcgaacgcctctgacaagtgtgtacctacgtgtcagggagcctgctcacatgaccgtgtggagaaagttctttccct

SEQ ID NO: 13703 - DNA, 412 bp, Homo sapiens
agataagccagtttaggtgaaatgaaattctgacctaaatataaaacaaaagtttcatttctgcctctttgctagaaaggttccttattcaaaataagaactcctaagacatttaaaagaagatctgttcctcggctgggcgcggtggctcacgcctgaaccccagtactttgggaggccgaggcgggcggatcacgaggtcaggagattgagaccatcctggctaacacggtgaaatcccgtctctactaaaaatacaaaaaattagccaggcgtggtgataggtgcctgtagtcccagctactcgggaggctaaggcaggggaatggcatgaacccaagaagcagagcttgcagtgagccgagattcaaccactgcactccagcctgggagacagagtaagactctgtct

SEQ ID NO: 13704 - DNA, 455 bp, Homo sapiens
gaaatgatttgacaccatcagttacgacaatatacattatgtagtttggcagcattgtattttcttgagcaaagactcagcgcagggcctggggttaactactccaagtggaagccaggctaatgttaggtcaagtctcttagcacagtgtttaggcaaatcctttttgcttcagggaagttcacagtccctcctcttgttcaagagaaagaatgaatttctttctcgtagaataaatatagttgttgcactccaaagtcctcaaaagaaaaaagttcagccattgtttatcatcattgtgcaattcaggaagagtcaaggtggtaaatgcaacaatcgaggaggtttggtgtactatcaatggtggcacaattgtctcataagaatagagatgcacttggtgggtcatgcctgtaatcccaacactttgggacgctgaggtgggtggatcacga

SEQ ID NO: 13705 - DNA, 624 bp, Homo sapiens
ggcacgagcggcggcctcgcctcgcacccccagccagtccgtcgatccagctgccagcgcagccgccagcgccggcacatcccgctctgggctttaaacgtgacccctcgcctcgactcgccctgccctgtgaaaatgttggtgcttcttgctttcatcatcgccttccacatcacctctgcagccttgctgttcattgccaccgtcgacaatgcctggtgggtaggagatgagttttttgcagatgtctggagaatatgtaccaacaacacgaattgcacagtcatcaatgacagctttcaagagtactccacgctgcaggcggtccaggccaccatgatcctctccaccattctctgctgcatcgccttcttcatcttcgtgctccagctcttccgcctgaagcagggagagaggtttgtcctaacctccatcatccagctaatgtcatgtctgtgtgtcatgattgcggcctccatttatacagacaggcgtgaagacattcacgacaaaaacgcgaaattctatcccgtgaccagagaaggcagctacggctactcctacatcctggcgtgggtggccttcgcctgcaccttcatcagcggcatgatgtacctgatactg

SEQ ID NO: 13706 - DNA, 442 bp, Homo sapiens
ggcacgagaaaacatttcatcttgatttttattaaggtgatatgtatgttacttaacagctgtataatacacatttgcatgcattaggaagttttttttgggttttattcatcctgtagtgatgtatctgtgacctcaacgagtaggcacttctgtactgtactggtttcttaaagtttcttttatcccgcccccacccccaacctcagcctcaagtatgtaacaccatgcctggctaatttttgatttttttttttttttttttaaaaaaaattttctttttgcccccgggttgaataacaggggcggaatttgggttaattgaaaccttggcttttggggttaaagaaattttcctgcctaaccctccaaagaagtgggccctaaaagggcttcccccccccccaagttattttttgttttttgggaaaaaagggggttt

SEQ ID NO: 13707 - DNA, 561 bp, Homo sapiens
tagaaaatatgtatatttggatatactatgtgccaggcacgattccaagcccctgatacattctctacattttacagatgggggaaggaggtccagagatgttaaatacttgcccaaggtcacacagaaagtggaacactgggatttgaacaaggttttggttgggcatcttttcctatgggagctcagaaatatctgttgtctagccctttctcagcctcccaaccttctcggttccttacctatgtcacagctgactttgagctaaagtcatctcggggcagctaggtgcctatgtgagctggcgttcatttctcactgtttctccttccaaatacctccaggaagaaaagcaagtcctttttggtccaagacattaaaaaagccaggctcagcggctcatgcctgtaatcccaacacttggggaggctgaggcaggaggatcgcttgagcccgggagctggagaccagcctggacatgttaacatagcaagacccctctacagaaaatgttaaaaatgagctgggtgtggtggcgcacacctgtagtcccagttactc

SEQ ID NO: 13708 - DNA, 611 bp, Homo sapiens
ggcacgaggggccacgtcttgagcctgggcgccagcagcttcgtggaggaggagcaccagacctggtacttccttgtgaacaccctgtgtctagctctgagccaagaaacctacagaaactactttctgggagatgacggtgagcctccgtgtggcctctgtgtggaacaagggcatgacggggccacagcagcgtggcaggacgggcctggctgtgatgtcctggagcgagacaaaggccacggaagcccctctacctccgaagtgctcagaggccgcgagaagtggatggtgctggccagtccgtggctaatactggcctgctgccggctgctgcgctccctaaaccagacaggtgtgcagtgggctcaccggcctgacctcggccactggctcaccagctctgaccacaaagccgagctctctgtcctggctgccctctccctcctcgtagtttttgtgctggtgcagagggggtgctcccctgtgtccaaggctgccctggcgctggggctgctgggcgtctactgctaccgggcggccatcgggagtgtccggttcccgtggcggccggacagcaaggacatttccaagggtattattgaagctcg

SEQ ID NO: 13709 - DNA, 629 bp, Homo sapiens
ggcacgaggcaggactgggtcacatcattggacctataaaagaagatcacgtccggtattcccaaggactccaggtggaaaagttcagctggggaggtgattccatccagagtcatatctgttgtcaccccaataagtcgatcagcaaggctgacaggctgtgaggaaaccccggccttgtagcctgtcacctctggggggatgatgactgcctggcagacgtaggctgtgatagatttggagaaccctgactcaccctcaggaatccggaggtcagtgacattgtcggtgcacacagacattttcctaccctggtttccacagagactgagggtaaagtgatggaagtatttcaaccctttggaagtgaagcttggccctccagcaagagtgacggtgtttgccaaagcggagaagttgtagttgaaagtcctggttggagtgttgcgtgagaaggtgcaatcattgtagcacagagagtggatcttgttgttcttggtccctggaccacagggcacacaggcctggacaccataaggctggtgggctttcagaattgtgttaggggggcaggagtggcaggttcctgaatctcggtcaatatagtaaccagcaggacaagaggtgca

SEQ ID NO: 13710 - DNA, 436 bp, Homo sapiens
  misc_feature 357, 369, 372, 376, 382: n = A,T,C or G
tcgaattcggcacgaggcagcctcaacctcctaggctcaagggatcctcccacctcagccttctgagtagctgggaccacaggccctcaccaccatgcccagataatttttgcactttttgtataggtggggtttcgccgtgatttcccaggctggtctcgaactcctgggctcaagcaatacacctgcctcagcctcccaaaattctgagattacaggtgtgagccgctgcacctggccaaagtgttcttatttttgctttttcaacgccacatctacctggagcatcctctttctgataagtctcatggacttcctatggcatgcaagagaggccacccctatgctgagctgctngggaagagccangangacngatccngctgtaccttagggctgagaagtgtgaaagaccactcagaccctgctttgctgg

SEQ ID NO: 13711 - DNA, 611 bp, Homo sapiens
ccgggcgagtacttcagcgttgggagccaggtgtcgtgccggacgtgccaggagcagcggctgcagggcgaggtggtagcctttgactaccaatccaaaatgctggctttaaaatgtccctcttccagtggaaagcccaaccatgcagacatcttgctcataaacttacagtatgtttcagaagtggaaataattaatgaccgaacagaaacccctcctcccctagcttcactcaatgttagtaagcttgccagcaaagcacggacagagaaggaggagaagctgagccaggcctatgcaatcagtgctggtgtctctctagagggccagcagctcttccagaccattcacaagaccattaaagactgtaaatggcaagaaaaaaacatcgtagtcatggaagaagttgttattacacccccatatcaagtggaaaactgtaaaggcaaagaggggagtgcactgagccatgtacgcaaaatagttgaaaaacattttagagacgtggaaagccaaaagatactgcaacgttcacaagcccagcaaccacagaaggaggctgccctgtcatcctgagtccgtacacatggaggactcttccagcatccagc

SEQ ID NO: 13712 - DNA, 623 bp, Homo sapiens
ggcacgagatttctgccgagtcgagctggacacccggagatcagggaggcagcagttgcagtccatcaaggggaccaaactcaccatcacccaggctgtcacaaccaccaccacctggaggcccagcagcacaaccaccatagccggcctcagggtcacagaaagcaaagggcactcagaatcatggcacctaagtctggacactgccatcagggttgcattggctgtcgctgtgctcaaaactgtcattttgggactgctgtgcctcctcctcctgtggtggaggagaaggaaaggtagcagggcgccaagcagtgacttctgaccaacagagtgtggggagaagggatgtgtattagccccggaggacgtgatgtgagacccgcttgtgagtcctccacactcgttccccattggcaagatacatggagagcaccctgaggacctttaaaaggcaaagccgcaaggcagaaggaggctgggtccctgaatcaccgactggaggagagttacctacaagagccttcatccaggagcatccacactgcaatgatataggaatgaggtctgaactccactgaattaaaccactggcatttgggggctgtttattatagcagtgc

SEQ ID NO: 13713 - DNA, 503 bp, Homo sapiens
aaaatcagaaagagtttgaaagggtacgagtgatttacaagtatgccctggacagaatttcaaaacaagatgcccaagaactctttaaaaattataccatctttgagaagaagtttggtgataggcggggtattgaagatatcattgtgagcaaacggagattccagtacgaagaagaagtgaaggcgaatccacacaattatgatgcatggtttgattacttgcgcttggtagaaagtgacgcagaagctgaagccgtgagagaagtctatgaaagggccattgccaatgtcccacccattcaggagaagaggcactggaagcgctacatttatctttggatcaactatgcactctatgaagaattggaggcaaaggatcctgagaggacaagacaggtgtatcaagcctctttggaactaattcctcacaaaaagttcacatttgccaaaatgtggatactgtatgcacagtttgaaatacgacagaagaatctgtcatta

SEQ ID NO: 13714 - DNA, 376 bp, Homo sapiens
  misc_feature 225, 232, 247, 253, 257, 263, 270, 281, 285, 290, 296, 308,313, 325, 342, 363: n = A,T,C or G
aatttttgtatttttagtagagacggggtttcaccatgttggccaggttggtctctaactcctgaccttgtgatccgcccaccttggcctcccaaagtgctgggattacaagcatgagccactgtgcccagctgagtctacctttttttttttaggagttgtaaataaaacaagaaaataacactattagttattttattactaactatacaactactttaacanaacactnttttttcccaggggnggggtngggngtaaangggcctnttgtaaaaatnactnttggncatggnaatgggggattnataanaattttgccatnttagggctgctcacagnatttggggccaaaccctacgngaatatatgtggg

SEQ ID NO: 13715 - DNA, 486 bp, Homo sapiens
ggcacgagatgcagtgtaactggcaggaggggagtgagaactacttgggtagatgatcaggagatactctgcaagaggaaacatacagaaggagcctgacatgagaaaactggggcagcagttttccaggaagagggaccagcacaggtccaagttgaaactcagaatggaattttaggaaattatattcttcatgatggttagatcctgtgggctatcatcactgcagttcaacaatgtggtgcctagtaggaagagttctcccaggaaccctccacgtgtgctatgggatttctgagaaaaccagttctgagttctaggcagtggactcacagttgaacttggagggaaccaagaattgcttccatcatagccttactaagaaatgaccatggcatggcctgagtgcttcggcatggaggaccagaaggggaagccctaatttgccagttgcagactcttgagccttgtgactctaatgacgac

SEQ ID NO: 13716 - DNA, 536 bp, Homo sapiens
  misc_feature 472: n = A,T,C or G
ggcacgaggggattacaggcgtgagccaccgcgcccagcctcatatcccccatttcaaacacgctgtaaacaatgctcaattactttcctcttaagttgaaaccaccaattactggggaaaggggcagttagattttattggttgactttgtgtttttactaatccttgttgaaaagtagaggaattggtttagttgagaaaacaaaatactaaaaaatctgccactagactttttaagtcaagagtttgtataaaatgaaacatatctactatctaatctataaaatttagaatctttttaattctaaagttaacttaagtgtgatttttagtgctgttgctgaggccagtgttgcttaaagcaggaacttctacagtaattgacaaaacttgagtttttctgctctcatttatccatccttcagacccctcagatgtcatctatttcctgaaatctgacttctccagttntagtaattcttacaatttttcaggatttagatagtactgtacagtttactgctatgtatatgtc

SEQ ID NO: 13717 - DNA, 399 bp, Homo sapiens
ggcacgagggaagatgagctcgccaagaagcgggcggccttcctcctgaagcagcagcgcaaggccgaggaggcccgcgtgcgcaagcagcagctggaagcggaggtggagctcaagcgtgacgaagcccggcgcaaagctgaggaagaccgggtgcggaaggaggaggagaaggcgcggcgcgagctcatcaagcaggagtacctgcggaggaagcagcagcagatcctagaggagcaggggctcggcaagcccaagtcaaagccgaagaagccgcggccgaagtcggtgcaccgggaagagtcgtgcagcgactccggcaccaagtgctcctccacccctgataacttgagccggactcagtcaggctccagcctgtccttggcctctgcggcgaca

SEQ ID NO: 13718 - DNA, 416 bp, Homo sapiens
ggcacgaggcctcatccatggatcagggaggcacgctagggagtaacccagttctgcccagcaggctacacccaactaactctggcccctgtctgtgctatttaacatttcattaatacaggagctcctgggaagaagcttggctcagtatccttggcagatcacccctcaaagtctccctcaggtatattctaagtgaggacggatcccatatatacctcacttaggctttactctgctctgcaagcacaggcaagaccagctacatctttgcacgccacccctggttcttagtaggccaagaacctcagaaactggcagggcactaagagctgtatcttagaaactgtgttgaagttacatttattcagctttgatctgggtgggccctgtacctggcactgctaacaagtgtt

SEQ ID NO: 13719 - DNA, 560 bp, Homo sapiens
tagttatgtttcataatgtgttttcttaaaaaggtttctcagaggcaagcgtggtggcatacgcctgtagtttcagctactcaagaggctgaggtgggaggatcatttgattccaggagttttagtccagcttagacagcggagtgagacccctgtctcctatacagagagagaaagaaagagttaaaaaaaagtttctaaaatctttttggtaactctatacccttagagttttgctgagacaaattaaataatacatatttttagctgggcttggtggtgcatgcctgtagtcccagctacttggaaggctgaggtgggaggatcaattgaacctgggaggtcaaggctgcagtgaactgtgatgacatcactgcactcagcctgggcaacagagtgagaccctgtctcaaaaagataaaaaaattagggtcaggtgtggtggctcacgcctgtaatcccagcactttgggaggctgaggttggtggattaactgagataaagatttcgagaccagcccagccaatatggcaaaaccccatctctactaaaaatacac

SEQ ID NO: 13720 - DNA, 405 bp, Homo sapiens
cacaaaccgtcctttcttacgcaaactagctgggaataaacaggccccctgtgggtcttagaactaaagcaaatatgaacctcaaagaacaaaggaaaatcattactggtggcaggaatatgagagtgcttccacaatactatttcacaagtcttttctacatgggcttcagtcacaaaggtggtttgacattcactgagcagcatgggaacaattctagaacacttattctatccctgagctatttctgggataaaaatattgttaaaatacggctgggcaccgtggctcatgcctgtaatcccagcactttgagaggctgaggcaggcagatcacctgaggtcaggagcttgagaccagcctggccaacatggtgaaaccccatctctactaaaaatacaaaa

SEQ ID NO: 13721 - DNA, 348 bp, Homo sapiens
tcatccctctctacgataaggttgcagaaatgggaagagctacccgtggttgcttttgattacccttaggaagtgagacagtgtttttgaaaatatgtatttcccccatttctccctctccttccctgacacttctctgggctgcacagcagaaacgttggtaaaagggcagtttggtttcaacacagcagacctgatatgggatcccttagccactttagtcaaacagccctgacagagtctataattgagttcaggccccccaccttgcctaataactgcaaatcgcatgttcagccagcagcctcctaagcccaccttcctcccccattagagaacacccatcct

SEQ ID NO: 13722 - DNA, 625 bp, Homo sapiens
cgggcgcccctcccccagcctcgctgccgccttgcagtttgatctcagactgctgtgctagcaatcagcgagactccgtgggcgtaggaccctccgagccaggtgtgggatataatctcgtggtgcgccgttttttaagcccgtcggaaaagcgcagtattcgggtggggtgacctgattttccaggtgccctcagtcacccctttctttgactcggaaagggaactccctgaccccttgcgcttcccaagtgaggcaatgcctcgccctgcttcggctcgcacacggtgtgcgcacccactgacctgcgcccactgtctggcactccctagtgagatgaactgggtacctcagatggaaatgcagaaatcacccgtcttctgcgtcgctcacgctgggagctgtagaccggagctgttcctattcggccatcttggctcctcctgcttctttccttgatatgatgttcaaaccaggaaaatgtgcaaatatcaaggttacctgggtctgctggtcacttctagtttttggactcttgaagatggaaactgttcttagaagaggcctgaagagaaacatgactgactagatccaatcctctggcattacatcaatgcagaaagag

SEQ ID NO: 13723 - DNA, 551 bp, Homo sapiens
tggtacgtacctgtagtcccagctactcaggaggctgaggtgggagaattgcttgagcctaagaggtcgaggctgcagtgaggtgtggtcgcagcctgggtaacagagtgagatcctgtttgaaaaaaaaagagcaaagggcaaaaaactaagagttgcatatgaaagaaataccaatgaataccacggaaaagatgttcaattccattcataagatgagatatacacatttggtttataaaaagatagtggtcttcacctaaaaaaaaatagcaaaagttaaaagtctcagtatatactatatttgttgaagctgcttcagggaaagaatccagccttgatggtagaagtataaattgataccacctcttcatttgtaatacagctattaaagtaagtgcctataccctttgaacaatccaatttttagaaattcatcctacaggacaaagatataagtaccgggatcttcatttatggtataattaatgacaaaagactaaaaatgaccttatcgtcaggaagagaggacagcttgaataaattacgtg

SEQ ID NO: 13724 - DNA, 544 bp, Homo sapiens
ttaaagattaagaatactcaatgcgccaagaagtgctatataccagaaaagtttgtatcaattaatgtatctaaattaagttaaagtttctttcaatttaatgtgcttgcagatgtaaaattgcatgtttaagttttgcagttatgtactaaatctggtgctacacttctaatgtctaaaggttttattcaatttcaatttatttgttttatagtttgccagaatgtgcttatgaaaggcactctcagtcataaaaataaaattataagcagactggcacataactatttttttaaataataaactttctgattttagagacttgtattcttttataggtcctggttctctttcacgctctgacctataagaacccatacagcatgcattgctgtgtatggaaaagcagtaaagggaagtacagccaccttttaggtcccatgaatagcaaaatctctttgactaatctcttgtttcagggtatgtccactccttgtttaaagaatgtaactggctgggcttggtggctcactcctgtaatccc

SEQ ID NO: 13725 - DNA, 553 bp, Homo sapiens
ctcatgtaaggaatgaaccaatcttaaaagaagaaaacataattctacaaaacttttcaaaatctagactttaaaactcttttatgtcatcgtggtgctatcactattctaatagtttccttgagctaaaaatctggacagaattcatattttcttggaagaatcattttacttgtaattcaactgtctacctacaaatttagatttgccctgttgctcttcttcctttaattaacaaaattgagtagctttttatgttggagatatgttgcataccaatggggaaaaaataaaataattatatctccggccgggcctggtggctcctgcctgtaatcccagcacattgagaggccgaggcgggtggatcatgaggtcaggagaccatcctggctaacacggtgaaaccttgtctctactaaaaatacaaaaaattagccaggcatggtggcgggtgcctgtagtcccagctactctggaggctgaggcaggagaatggcgtgaaccctggaggtagagcttgcagtgagcagagaccgtgccactgcacact

SEQ ID NO: 13726 - DNA, 591 bp, Homo sapiens; identical to SEQ ID NO: 8870

SEQ ID NO: 13727 - DNA, 372 bp, Homo sapiens
gcccaccaccatgcccagctaattttttgtattattagtagagacagggtttcactgtgttagccaggatggtctcaatctcctgacctcgtgatccgcctgcctcggcctcccaaagtgctgggattacaggtgtgagccaccgtcccgacttatttcagccatttttaatttgctaatagtcacgaaagatttttcctagtaaaaattctgaactcaacagcaaacaagttttcatgtttaaaacaatcaatcctcaaaatcctctaatcttcctaaatattctatgtctgataggaataaaatgatgagataacgcatatattttgctatagaattttgcacagaatttaaacagaaatgtcatttatc

SEQ ID NO: 13728 - DNA, 638 bp, Homo sapiens
ggcacgaggccagagtcgccctggttttctatggcgtcttccaggaccggaccctgcacgtgaggtatacggacatcgactaccaggtcttcaccgacgccgcgcgcttcgtcacggaggggcgctcgccttacctgagagccacgtaccgttacaccccgctgctgggttggctcctcactcccaacatctacctcagcgagctctttggaaagtttctcttcatcagctgcgacctcctcaccgctttcctcttataccgcctgctgctgctgaaggggctggggcgccgccaggcttgtggctactgtgtcttttggcttcttaaccccctgcctatggcagtatccagccgcggtaatgcggactctattgtcgcctccctggtcctgatggtcctctacttgataaagaaaagactcgtcgcgtgtgcagctgtattctatggtttcgcggtgcatatgaagatatatccagtgacttacatccttcccataaccctccacctgcttccagatcgcgacaatgacaaaagcctccgtcaattccggtacactttccaggcttgtttgtacgagctcctgaaaggctgtgtaatcgggctgtgctgctgtttgtagcagttgctggactcacgt

SEQ ID NO: 13729 - DNA, 336 bp, Homo sapiens
ggcacgagctgtggtcctgtggtcccagctactcaggaagctgaggcagttgaggctgcagtgagccacgttctggccactacactccagcctgggcatcaaagtgacaagaccaaaaaaaaaaaaaaatgggggttggaaggggggcaaaaaaaaatccggaaaaggggggaaaggaaatcccttagggacaaatttttactcaaattggtttcccaaactttgggaaaagggccaaaaccgaaggtttttttgaatttatttaaccaaaaccccacccctaattaagggcaggggcatgggaaaaaaaaaacccacttggaaaaattttaaagg

SEQ ID NO: 13730 - DNA, 403 bp, Homo sapiens
ggcacgaggagagagagagagagagagatagagagagagagagagagagagagagagagagagagagagagagagagagagagagagagagagagagtgtgtgtgtgtgagagagagagagagagtttctctctctctgtggtatatatatacacccactctctcttctttctctctagacacacaaagcggctctctcgcgggttttacccacgctctctcccccccagaatatactgcgcgctttcccctcctctgtatatccgcgcgcgcgcgcacgtgggatatattctctctctctctctgcgcgcgcacacacatatcccgcgtggttttctctctctctctctcttcccgtgagagagagagtgtgtctctattttctctctcttgcgcacgttcc

SEQ ID NO: 13731 - DNA, 395 bp, Homo sapiens
ggcacgagaatggatctgaatttgacaaatagcatgccacactaatactacagtcaacaacagcccagagaacaattactatgtcagctggaggctatattatgattctaaattcttaaaggtttttttccctccataaatcaaaaattaccttatgtaaaccaaaaattagttggtatttatggtcatgatcttaattctcaagtttagcttaatcttgtatttcattgtttgtcttctaatatgacagcttaaattcagatttttaagtgactcagcaaaataggaggagtgtcccaatttattagtgttgtacatattgaagaaaacctttttgttccttcagatttagaaagaaacagtttaaccatttatttcttggtattctgctgctg

SEQ ID NO: 13732 - DNA, 523 bp, Homo sapiens
actggcaaccagagaatgttaaccaggctttcaccagacccccacctccctatcctgggaacattaggtctcctgttgcccctcctttaggacctagatatgctgttttcccaaaagatcagcgtggaccctatcctcctgatgttgctagtatggggatgagacctcatggatttagatttggatttccaggaggtagtcatggtaccatgccgagtcaagagcgcttccttgtgcctcctcagcaaatacagggatctggagtttctccacagctaagaagatcagtatctgtagatatgcctaggcctttaaataactcacaaatgaataatccagttggacttcctcagcatttttcaccacagagcttgccagttcagcagcacaacatactgggccaagcatatattgaactgagacatagggctcctgacggaaggcaacggctgcctttcagtgctccacctggcagcgttgtagaggcatcttctaatctgagacatggaaacttcattccccg

SEQ ID NO: 13733 - DNA, 567 bp, Homo sapiens
aagtgccagactcccgccaggcagaaactgaagctgaagtgaaaaagaagaagaacaagaagaagaacaaaaaggtgaatggtctgcctcctgaaatagctgctgttcctgagctggcaaaatactgggcccagaggtacaggctcttctcccgttttgatgatgggattaagttggacagagagggctggttttcagttacacccgagaagattgctgaacacattgctggccgtgttagtcagtccttcaagtgtgacgttgtagtagacgcattctgtggagttggaggaaataccattcagtttgccttaacaggaatgagagtgattgccattgatatcgatcctgttaagattgcccttgctcgcaataatgcagaagtttatgggatagcagataagatagagttcatctgtggagatttcttgctgctggcttcttttttaaaggctgatgttgtgttcctcagcccaccttggggagggccagactatgccactgcagagacctttgacattagaacaatgatgtctcctgatggctttgaaattttcagactttcta

SEQ ID NO: 13734 - DNA, 417 bp, Homo sapiens
  misc_feature 1, 315, 318, 319, 320, 321, 322, 323, 324, 325, 328, 329,331, 332, 333, 338, 339, 340, 341, 345, 361, 362, 365, 373,378: n = A,T,C or G
nccggcacgagcgggaaccctgctcagtcctgccgggcactgcatgcagggaccgtccgcctgacccagagacctggggctgcctcaccctctctccagacccacagccagctttgtttcttgaatgtggaagatgtttcttattccctgaagaaagggggcctgccacacacagcctgggaggcgcctcatccagaaactgggacttggctagcccggcctgggccctagggacttctcactggtcatgcttctgaagctgctcacctggccgagggaggtcccggcagtgtcccagggtggaaggtggggggnggnnnnnnnntgnntnnnttttnnnntgtntttttgtggtgtttgnnggnttgttttnttgtnttttgttaggcgaggggtggttttgctttgttttgggtg

SEQ ID NO: 13735 - DNA, 563 bp, Homo sapiens
actaagcaaaattagaaatgtcttggtttatatatttcttcccatgctttctgtctctacaaccagaatataagcttcagaacaagagtattcaaatctggtgtgtttatccccagactcacaacactgggtccagagcaggtcctcagtagatgtttataaatatcaggatgtattacatatattaactttttatgagtagttattatttattatattccacttagatatggaattattacttcaggtggtagctgacttgtactggaaaagtgactgagcccaactctaatgctaatgttaattggatttatatgaagtttctttggttttaattgcactttgaatgaattcaagaatttcactagctataacttctatctatggtaagaagcgttgtccaagccacagaacctcaagattacaacagagatttaaattaaaactcttctaattgttattattgtaattattataattcaccaactggacaattggaacaataaactcttggaatttaaattaagtatggaatggggatggatgtttggggtgctttatag

SEQ ID NO: 13736 - DNA, 569 bp, Homo sapiens
tgcacccagcccatagtgttttgaagctaagatgcgttcagccctcccagaatcttagggattatatgaatcctctatttaaattctgttcccagccctgagggttgatcacagaaacagtagcttagagaaacaacatacctgtagtgtcacatgttgaaagattcctattcagagatgataaccattgttcattctttgcctctactgggaaaagtgtgcttttgcttcccataagaactcaaaatttaggcttgttttaaggaaggaggctatcattgaccaaattgtagatagacagccaggtgcggtggcttatgcctataatcccagcactttgggaggcagaggtggacagatcacttgaggccaggagtccaagaccagcctggccaacatggtgaaaccccatctctactaaaaatacaaaaattagccaggcatgatggctcatgcctgtaatctcagctacttgggaagctgagggatgagaaatgcttgaacctgggaggcagaggttgcagtaaactgagattgcactactgcactccagcctgggcaacagaaca

SEQ ID NO: 13737 - DNA, 509 bp, Homo sapiens
aatgcagctaacagattatctgagagactggccttgtggtaaatcatactgagagcctgctaggagatataggaagaattggaaatgggtacacacaaaactaagcaaattaacaatcagggcaattattaacttcaggagaaataaaaaaaaagtatactacaatgttcagttattaatatttgcataacaatgtaaatactgaatattggtatattgtaaatggtaatatagctatattggggcttataactaatttatctatctataataaagagaagtcaatggatatcttgaaattatgaatcaaaaggatcaatatttatttagaaaaatatgctgggcacagtggctcaagcctgtaatcccagcactttgggaggctgagacgggtgaatcacaaggtcaggagttcgagatcagcctggccaacatagtgaaaccccgtctctactaaaatataaaaattagtcgggtgtggtggcatgcgcgtgtagtcccagctactc

SEQ ID NO: 13738 - DNA, 273 bp, Homo sapiens
aggcccctggctcaggcagagggagatggttagactcttgcagggctaaaactctaatttggaattgaatattgtggatatcttagttaaaggccatgcttacagcttagaaatgaagccttaagctgcatcatcatatcgccctgtgtggtctgcaggggagcaggacaagccaagcagaaaaagcgagtgatgatccctgtgcctgcaggagtcgaggatggccagaccgtgaggatgcctgtgggaaaaagggaaattttcattacgttc

SEQ ID NO: 13739 - DNA, 424 bp, Homo sapiens
attccacattttcaagaaataaggaggcaaaaactttcatatatgaattggaattatttgttttcttattaggccgagatgcgccgcgtgcggctgctggagatggcggacgcgatggatatgttctgccaagggttggtttgcgcattcacagttctccgcaagaattgattggctccaattcttggagtggtgaagaaagaaaaaagttgaactagatttggtctgatgcagttacagatttacaaactgtgcccccaccctcctgcagacaccttccactcctcattcttgagggattagggatggaggtcatgcttctgtatcgacttcatgctgaccagggtcactgagtcccctaaagtgagaggaatgaaactcttgggcttctgagttcaaatgagttctggggtcacctggagta

SEQ ID NO: 13740 - DNA, 526 bp, Homo sapiens
ggcacgaggtctagtataatcttgatgctcaaaccagataaggacaatacaagaaaggaagagtataggctaattctacccaataactaaatgaagtattagcaaaccagattcatcaataatcttttaaaaatcaagaattaattggatttaggaatataacactgtgtataacaagtttaagagaaatatatgagaatgataagactgcaattgaaagtagaggctttctctggagggaaaggtgaggaggatgtgatttggaagaacagcatggggaggcatcagttgtattgtaatgtttattttttaagctgaatgataggtacgtagatgttcattgtgttctttatgcctttttgtatatcttaaatatatggtagtgccatgattagcaggcttaatagccttgtgagtttaaatgtcactttcaaatgctgtatttttggtggagttgcttaaacacattccccttggaatctatacaaccagttaaaaaaatcatgtataaaccaccatgaaatat

SEQ ID NO: 13741 - DNA, 603 bp, Homo sapiens
tggctggtattataggtgcacaccaccacacccaactagttttttgtgtttttagtagagatggggtttcatgatgttggccaagctggtctcgagctcctgaccccaggtgatccacccacctcggcctcccagggtgctggaattataggcgtgagccactgcgcacggcctggggaggttttatttcttgacaaaggtatttgatactcgtgcagaccctggagggtctcactggagagacaacatttaggctgagatctgattaacaggaggcagctgcagtgcagaggtcaaaagggagggtgttccaggcagagaaaacagcctgtgcaaaggccctgaggcagaaacaaactctacttgaggtcagcctggttagaaaacccaactcaaaatagaaagtattacatgataaggtctgagatcagaacccaagtctgcacttcctagtcacgttctccctgtagtgctaagcccagagacctgagctgttaacctagaacagtgtgcttcctaagccttaatgtgcatacccatcgcctggagctcgccttaagatgtaggctctgcctgaagcccaagttcatttagtatgtcatg

SEQ ID NO: 13742 - DNA, 542 bp, Homo sapiens
ccatctggggcagcaccacgtggatctctccctcgtcaccttcaactggttcctcgtggtctttgcggacagtctcattagcaacatcctccttcgggtctgggatgccttcctgtacgaggggacgaaggtggtgtttcgctatgccttggccattttcaagtacaacgagaaggagatcttgaggctacagaatggcctggaaatctaccagtacctgcgcttcttcaccaagaccatctccaacagccggaagctgatgaacatcgccttcaatgacatgaaccccttccgcatgaaacagctgcggcagctgcgcatggtccaccgggagcggctggaggctgagctgcgggagctggagcagcttaaggcagagtacctggagaggcgggcatcccggcgcagagctgtgtccgagggctgtgccagcgaggacgaggtggagggggaagcctgacttggccacctcccctccccacagccttcctcacccttggctggcagacccactggaggtcaggcacggaccagtggcccag

SEQ ID NO: 13743 - DNA, 613 bp, Homo sapiens
ggcagagaaactagggagcccggggacctctccacatattctttgctctgtacacttaatcaagataagaaataaagacagcaagactgcaaaaagtctattatgtagacttgcaaaaagtctacataataatataaattcaagccaagtagaagtgattttgcaagtctgtgtatgattaattggctagtgaaatatatggataaaattagttgtaggaattaaagcatctgaagtgatctcttgaggctctggtggcaaagcagaaaggggaatttgaatttgaactaggtttaaaagtgtgagtagtagccctttcttttggcaggggaggtgatcctacccattctccttagagcctgtgcaattggtctcagtgtttctcaacatctaagaatgaagctgcattcttaatgctttagtagctgtgcttcaaaacggcaagtttccttttgagagtgattttctctttgttctagcttgtttcactaggcggataagcgtgggcagtaaactgggaggtgtccctttatcagcacctctcagcttcacccaccctgctgcttgccctgggcagtagcctggtcacatctttgaaaacctctgtttagtc

SEQ ID NO: 13744 - DNA, 421 bp, Homo sapiens
atccacccacctcagcctccaaaagtgctaggattacaggcatgagccaccgcgcctggcctgtctaatcttttatttaatgcatctaggctcctcctttcttccttcatggtttcctttttcctacttccctatctcgttttctttccttcttttcatttacagagaaatggtgttagaaatgaatgagaggagtgagcaaagaaagatgagggaaaaatagatgtgttaaggagtatacgcataaagaaaagaggccaggaggaaaagctgttcaccccgactcccatcctaatcttgcgtagtctttcgtttcctgagaatagttaggtcagaagttacagtagaaactttcatggaatacacaaaagggaattaagtaaggaaacttgtgaccgatgctatgggaaaggacatgttt

SEQ ID NO: 13745 - DNA, 450 bp, Homo sapiens
gtatcttaacagtctggcagggggtgaagtctcctattgataagcagggcctacatctgctactctactgcagaggtgggtatctaacaactgcttccaaagagtcagtttctcccagggcttgggaactcctttgggagctacactaacttctaaaacatcagggaaccactgaacaaattatcatttcagtgcactcagtgatatcctaacggcctggaaacacagtcctaacctacctctagggtcttagagaacagttcacacagaaggaaatttgctcaataataataacaatgtcaagatactaacatatcaaatagtcttagagggaggctcttgagctacacttctccaggtgaattagcatcttcccttaactttccttcccagcaatgaaaaatgctcaacatgcagtaagaagagttttttgtttgtttttttgctttt

SEQ ID NO: 13746 - DNA, 651 bp, Homo sapiens
cctgtgtgttacctgattgtaacaaccctatgcccatttcatagactgggaaacgaggtactgagaagtgaaatagctcaaagtgatttcactggaaagagacacagcatgggaacctagttgtgacgcactggagcgccaggtcttaatcactgagcaagattgctgtccaaaaaataaaaccagttccactttgcagggaacccagggtttaaactagtaattcttagatattttagggaggagacgtgtataaaagtgtgtatttggggacagggctggtgaacaatcataaaacagaacaggcatgcatctgtccacaagaacagacttcacgagtctacagatgctgttcccagggaaatacacatcacatgtaatattgcatacattttcagaggatttaaaggtacacttggaatgggccaagcacagtggctcgtgcctgtaatcctaacactttgggaggatcgcttgagcccagaagtttaagaccagcctggccaacatggtgagaccccatctttatttaaaaaataaaaattaaaaaaaagagccgggcatagtagcctgtggtagttccagctaccccacaggctgaaacaggaagatagcttgagcccaggagatagaggtgacaatgagctacag

SEQ ID NO: 13747 - DNA, 646 bp, Homo sapiens
tttctactgtgcttaccctaatggattttttatatagtctcactttctaattcataatctgatctctagtttcatcagagcaccttagtttttaagtaaaggctcttcttctattaaccacttctaaaatgacaaatcgggcttattctatgcagttcaaaaaacagaacaaggctaagaggtgaagttatagaaaagacattttcactcacagaaggaaaaatttggacacagccagagtagttaaaacacaaaacaagaaaccagaatggacaaggttgaaaagtagtaaactttaagtcatttagtagcacttaagcagatgacaactatacctattcatttgttatattttggaggggcatcttatagtcttgattaagtgatttctgtacctctgaaatacagtagtctaggccaggcatggtggctcatgcctacaatcccagaactttgggagactaagcgggcagatcacctgaggtcaggagttcaagaccagcctggccaacatggtaaaaccctgtctctactaaaaatacaaaagttagctaggcctggtggcatgcgcctgtaatcccagctacttgggaggctgagaggaaaatcacttgaacccgggaggcggaggttgcaatgagctgag

SEQ ID NO: 13748 - DNA, 562 bp, Homo sapiens
ctggaatacacaatcgtttatgctagtgatctaggagcagagtgagaagaagattgagagtcttaatactcaaaatgatactttcatttaatctcaatatttagtatcaatacaggacctctgccttcagctattcctgttgtctgcaagtctagaaacttttccctttcctaataacaagcttgtagtagagtgccagggttggggttgcttagctgctgcaagtcagggaggacaactaggagatctcacagctccttacgcagactggcgatgaatctttctcttttaggcctgccttcacccctgcttccagggatatcttgtgcttgccagttcttgtgcctgctgtaaatcagtttgcttctctgctttcctagttctgcagtgaaaattattattctttaattttctttccagagtctaaaggtactgctttttatttcatcttcttgattttttataggtgtattccctttaaaaattacatttttatcattttagtaggatgtttggactgagcagaaactaatgaatgtgtacaactagttatctttactta

SEQ ID NO: 13749 - DNA, 547 bp, Homo sapiens
ggcacgaggcgcgctgcacaatggcggctctgaagagttggctgtcgcgcagcgtaacttcattcttcaggtacagacagtgtttgtgtgttcctgttgtggctaactttaagaagcggtgtttctcagaattgataagaccatggcacaaaactgtgacgattggctttggagtaaccctgtgtgcggttcctattgcacagaaatcagagcctcattcccttagtagtgaagcattgatgaggagagcagtgtctttggtaacagatagcacctctacctttctctctcagaccacatatgcgttgattgaagctattactgaatatactaaggctgtttataccttaacttctctttaccgacaatatacaagtttacttgggaaaatgaattcagaggaggaagatgaagtgtggcaggtgatcataggagccagagctgagatgacttcaaaacaccaagagtacttgaagctggaaaccacttggatgactgcagttggtctttcagagatggcagcagaagctgcatatcaaactggcgc

SEQ ID NO: 13750 - DNA, 453 bp, Homo sapiens
ggcacgaggtcgagtccagggccaaggcttgtgttcaatcgtgtgaatggccggcgggccccctccacgtccccatccttcgaggggacccaggagacctacacagtggcccacgaggagaatgtccgctttgtgtccgaagcctggcagcaggtgcaacagcagctggatggtggcccagccggtgagggcgggccaaggcctgtgcagtacgtggagaggacccccaatccccggctgcagaacgagtggtgggcgcagcagttcctggcgagaatcaccagctgttcctagtggctgctgggagggggcgctgctacacggccgacctgtcgccaggagagaagcatggcgccctgcccacccactgcgcctggctgggtgccggccacacctgaagtgccagcatttggacttttgcacctttttttcccttggcccggctgtcccaac

SEQ ID NO: 13751 - DNA, 549 bp, Homo sapiens
ggcacgaggttcgcagagctgcggaagatgaatgccagaggacttggatctgagctaaaggacagtattccagttactgaactttcagcaagtggaccttttgaaagtcatgatcttcttcggaaaggtttttcttgtgtgaaaaatgaacttttgcctagtcatccccttgaattatcagaaaaaaatttccagctcaaccaagataaaatgaatttttccacactgagaaacattcagggtctatttgctccgctaaaattacagatggaattcaaggcagtgcagcaggttcagcgtcttccatttctttcaagctcaaatctttcactggatgttttgaggggtaatgatgagactattggatttgaggatattcttaatgatccatcacaaagcgaagtcatgggagagccacacttgatggtggaatataaacttggtttactgtaatagtgtgctgttcatggaaaaccgaggctgcatcttgtttatagtcatctttgtactgtaatttgatgtacacaacattaaaagtactgacacctg

SEQ ID NO: 13752 - DNA, 462 bp, Homo sapiens
ggcacgaggttcataccaacatttattaagacttatttttcagtggtcctcaatcacagaacaattaagcaaccatatacaatttaacatacctgaatatgagaaacacatttaaattcattgttggattaaacacatttcaaaatggaaagacaaatattttatttactgacctaaaacaacactacctatgaaattcatgcactattgctttcagattacttacaggattatatcaatttaacatttctttgtgagattaagcatttgaaatccatagtcagagaactattttaaatatgagccactaattaacaaaatatacatatagcttctacatttccatcaggttatgtattttctagagactacatgacccgctatgcatgaggctttttgaagtacttacatttataggattttgctgtattagaagttttcaaatgactttttttttttttt

SEQ ID NO: 13753 - DNA, 625 bp, Homo sapiens
atggcggaggtgcaggtcctggtgcttgatggtcgaggccatctcctgggccgcctggcggccatcgtggctaaacaggccggaaggtggtggtcgtacgctgtgaaggcatcaacatttctggcaatttctacagaaacaagtgtaagttaggacctgggaggagcactggagagggtctccctgtggggtgttgaggctctgaaagcaattgcagccgtgttgggagaggctacttggggtttctgagaaggcccttggaagtggggttttgggggtgctggtagactgggcaggcctcacactctcccctctccctagtgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaagtcgtgcgtctgaagcctacaagaaagtttgcctatctggggcgcctggctcacgaggttggctggaagtaccaggcagtgac

SEQ ID NO: 13754 - DNA, 181 bp, Homo sapiens
ttgatgcccttgctctttgagttctgggctctggaggctttggattcaaagccctgctgcaccatttactcatcatgtgactttgggaaggtgaccattctctgagcctcacttctcctcctctgcaaaatgggattccagttcctaccttgcaggaccgctgttgtagaatcatacatgg

SEQ ID NO: 13755 - DNA, 467 bp, Homo sapiens
ttgttttgttttgtttttagagacagggtcttgctctgtcacccagactggagtacaatgacacaatcatagctcactgcagcctttaactactgggctcaagacatcctcctgcttcagcctccagagagttgggaccataggtgcacaccaccacacctagctaatttttgggggaggtcttgctatgttgcccaggctggtcttgaactcctgggctcatgcaatcctcctgccttggcctcccaaagcgctaggattagaggtgtgagccgctgcaccctgccccagtacaatcttttttgaactcaaatttttgctgacatctgagtgcacacaccacagtgtaaattatgccttatcagaatctaaatgaaaatagcgaacatttaaaagctatcaccattgtagtagaatcatccttcttttttgaaatttgaagcatcccaggcttaaaatcttgtgtt

SEQ ID NO: 13756 - DNA, 459 bp, Homo sapiens
cgtgtgctgtcgcattacccctactgcgggtcccgctgctggcagcgctggaaactgggtggacggcatgggttggtctcaggatttgttccgcgccttgtggagatcgctgtcaagggaagtgaaggagcacgtgggcacggaccaattcgggaacaaatactactacatcccgcagtacaagaactggacaggtgaggtggcggcgtgggcaacgattgcgtggtcagtgattgcgaggtcagtaaaggagggaaaagtgagagcccctagtctactaacgcatcatgcgacacttagggtgtcaccggagagaatttcccgagttcgttctcccctgtcgaccccttcactctggcatcggagccctacccggcccggctctgggcgccttggcccggcctcgtgcgtccgcggtccctactacccagcgccttcccccggcgtgccccgggctgc

SEQ ID NO: 13757 - DNA, 379 bp, Homo sapiens
ttaatatccggaagtagctgtcttcctacaccttagtcaatagctaatcaaacttcttaatcatgttaatcgggtatttttaaaatgctttcagtatagtttcaatttgcttaactcttacattgactgcaactgaggatcatttcatacatttaggagccacttgtctttcctttgaactgtctctgaatgtgcccacttgtctactgagttgttggtcttttctatcagcaagcgatcttgctttttaaaggaaattagccctttgaacatgctgcatggcaactatttcttcccagcttatcactggagtcccaattttgtttatactagtttttgccatgtctaggttgtctgtttgtttgtttatttatttatg

SEQ ID NO: 13758 - DNA, 116 bp, Homo sapiens
ggtggagccagcaggattcgctgaccaattggaggcaggacgtgagaaagaggagagctgagtctttgtgacttgcacatccataaggctgatcttgccctctggtaagactggcg

SEQ ID NO: 13759 - DNA, 649 bp, Homo sapiens
ttttacaatatggaaaataataataattattatttttttaagacagtcttgtgtcttgcttgttgcccaggcttggagtgccatggtgcaatgtcagctcactgcaacctccgcctcctgggttcaagcaattctcatgtcttagcctcccaagaagctgggattacaggcatgtgccaccatgccaggctaatttttgtatttttagtagagacatggttttaccatgttggccaggctggtctcaaacgcctagcctcatgtgatctgcccacttcagcctcccaaagtgctacaattacaggcgtgagccaccaatgcccagctggaaaataattattcttaacttttaaaaactaaatagaggtaatgaggagaaataaactaaattaaaaatgcagaactttgaatcctagcttcacaaaatatctggtttaataattctgttaaattcttttattcagtaaatactgacttggtacctacagagtacaatctatttcagaataaagtgtttaaaagagcaaaatacattgatgttcaattgttgactcatctataaaatgtgaactagaaacagattgttttttcaaagagccaatttcaaacagtactggaaactgtatggatcacgtactacacatactta

SEQ ID NO: 13760 - DNA, 569 bp, Homo sapiens
ggagtacagatgagggtcttttgaaaaatggcagtagtgaaagcaacatttctggttttcttcttggaaggaggagaaaggatagcttattctgaaattaagcaacaacaacaaactgttatgtaaatggagataaaactgttgttgaaaaatattggcttatattctagataaatacatacgcccacataatcccatacagggcaaataagtatgtgtgtctctgtgtgtgtgatgtgtgcatgcatgcatgcatgcttggtagactttatctgctcactgaatactttttccaacccaatgtatggaaagtgacagatggatcagcaatggctgagaagcagttacacatatctggccagcatggttttgattgtatgttgggttgtcagccagctacacaccagaactattattttaggcggctggaagagaattattcaatgtcaatgggaagagagagatacagaaaatgaaatagacactctgtgttttcaataaggcatcagtttgtttgaagccacatctaactgtctgaattcatatgagaacttactaaaagcaatgca

SEQ ID NO: 13761 - DNA, 476 bp, Homo sapiens
ggcacgaggaggaaagcggtgcgtgaggcgggcggccagggcacgactttgaagattatccaatgagaattttatatgaccttcattcagaagttcagactctaaaggatgatgttaatattcttcttgataaagcaagattggaaaatcaagaaggcattgatttcataaaggcaacaaaagtactaatggaaaaaaattcaatggatattatgaaaataagagagtatttccagaagtatggatatagtccacgtgtcaagaaaaattcagtacacgagcaagaagccattaactctgacccagagttgtctaattgtgaaaattttcagaagactgatgtgaaagatgatctgtctgatcctcctgttgcaagcagttgtatttctgagaagtctccacgtagtccacaactttcagattttggacttgagcggtacatcgtatcccaagttctaccaaaccctccacaggca

SEQ ID NO: 13762 - DNA, 438 bp, Homo sapiens
agaaagttaagtaacgtcctgaggctggaggggccccgctcctcctcaccttggggagaaggacagcgtgaggctagcctgccctacactgtgtggccccttcccctggcctgaagttgcagcacctgcaggctaaaccagcacatgcatgagggctgctgggccggggcttagggagcagccgatgctcctaaaaccctgctctgggtggactctagggatgcagttcgggtctgtgtctggggctggcagacaagcccacgtgcccacctctgcagaatgagaagtacgggtgggcaccaggccctgcccctcacgttctgctctttctctaagaactgcagaaccttggcaagccctttgcctctgcgtggggtgcccgtgtgcccctcatgaggataagcccttcgcccctgcgtggggtgcctgtgtgcccct

SEQ ID NO: 13763 - DNA, 538 bp, Homo sapiens
ggcacgagaggagatcgggacagagcatcctaagattcaggagattttcctagtcacagggagcagtgaattcagcaggccccaaggtaggaaggagtttggtctgtccaaggaacgcaagaaggtcagtgcatctgatgcagagtaagtctgaaggagagaggtcagggctgagatcagggaggtcgtctgaggcccctctgagggggacctgataaatgggtttgaattcattttgaagtgtaataggtccatattagaagcagaaactataaaaggagttatgctgataaacctagggatcataacagcacgaaaaaggcaattgataatatgacacaagcaagaaaaaattcacgtgattaaaataatacacttgcagagcttacaaagagaaatgtgagtcatccaggaaatctagttacatctaagtcttcattcatcttaccagataaatgaaatgctgaaatcttagttgcttgcatacataacacacagatattcttttatataacacattcatgtcataaaacatgtg

SEQ ID NO: 13764 - DNA, 579 bp, Homo sapiens
tctgtgcataaatggacatggattatatgtgttatagcaacctatcaccttggcaccttgttatcagcttactgacattcaaactccaagacagctagaagaatgactcttttccaccaaacagtattttaaacaaaacttaaacccaaagtgggatttggagttcacctctgagctcatggaaatgtgaataaggtctaagaccaggtcaaagtggtcaaatagcttggaattcattcagatattttttccttgtcaattaaaaaagggataattttctcttgccagtgagtagcctttggtttgggaatattgtataacccaagaaaccatcttaataaattagccaggaaatacactgcttgagcactcttgttgtttggcctatggggagaccatatggctaaatgggccaggggggataaaatggggcaggaaatatgcatgatgaacatcagggaattgcaatttttgtacattcacaatccaccacaattcattgcaccaaattcctttcattttttgtcactgatcacattcttatgaagcaacttctagtatgttgggtctataaaaacc

SEQ ID NO: 13765 - DNA, 349 bp, Homo sapiens
gtcttctctatggaggatatggcaaagacatacaaaattatatatacgtatccacacattaataactctatttctatattaaaaacatgaccacaagccaacacttttaattccactgcagcactgctgggttatttcttgctttccaaattcccttgtctgtagctatctttcatcacttgcaaaaatagcacgtgctcaatcctagattaaaatataagctactctcagaattgataactcataccactctttttaaaaatcaactaaccagaattcagtttttattcacagttcttatctttagctcagggcgtaatataaaagcactaggtttaaaacttacttg

SEQ ID NO: 13766 - DNA, 609 bp, Homo sapiens
gactttccctttatgaagaaaaatattcctttgaggaaaaaaaatcctcttattttgtaaagtagttccaagagacagctggcatattcaagatataacaaccactctagagagcaatgaatacaaacacacacaagaaaatctgtcacttaatggctaatattcgtaaactatcaacagagaaatgaagttcgtaattcagacagaaaacccatttgctcagtgtgttgctgataaaacatgcaacataagcaaattattaaaaacctaactgtagcaggtcgatagagagctctgcttctgtccccataatcccattattcaattaagcaatactacaggtagaacaggggacacaataattatcaccaacaacattgccattcatgcttctaccgcaggccaaacttccttcagatttttgtggaaggtatttgtatgtcataaatacataaaaagtcaagacacagataaattacctctattatcttttccaaggatgatccaaagaaaatgtcaaatctaagctgaaactcttagctgagtctggtaaagatatacttttatgtctttccttattataaatatctggctcatcattttcctcat

SEQ ID NO: 13767 - DNA, 572 bp, Homo sapiens
atgttctaagccttgtcttcaacaagaccattacagttgataaagtagtgaggtccacagggaaatttcctgcagcaacccagtaacatcaaaccaaagccaaaggtttggagccaggaaaggggctgagggagctggcaaattgcataatacctaaaactcttaggaaccaagagatatgccaagtaacaggtagcaaacttaaatgtgtacagtgtcttggcaagtagcaggagtgtgtaaagctgcttcgactgagaagggagacaataaggtatggtggagattgtggcaaagtagagaccacatgccctctactcagcactggccaattgttacctcctcttccaattttcaagtctaatgggaaagctatatttttatatgaaacctctgaattggcatttctctcagcatttttattttgtttttacatcatgtgtggataagacaaaacatgtctgcaggtaggcaatatctcctgaggcagtggaatggtccactgagttttctccttcagaaataaaacctatagctgtgacttgtctctgggctggggcaagacaaggctg

SEQ ID NO: 13768 - DNA, 355 bp, Homo sapiens
tcttcttggctccttttaccatctgaaatgacgtgtgaacagggtgcagtggcacatgactataatcccagcacttggggaggccaaggtgggagggttgtttgaggccagaagtttaagaccagcccaggtaacatagcaaggcctccatctctacaaaacaaacaaaattgatcgcgccactgcacttcagctctagcctggatgacagagtgagattctgtgccccaccccccacaaaaaaatagaataagaagtgatccccagagccctaaaatcctgaccgtcccagcgggacaaggctgaaaggtgttcagtggattctgagggacaaagaggtgggctgggctgggct

SEQ ID NO: 13769 - DNA, 500 bp, Homo sapiens
tacggctccgagaacacgacagaagggttgccttttcacactcgtatgagatgtgcctcccttgaaccttgttatgatgttggcacattacccatctgatgtgaaaaagaaaaataaggaaaaaaataaataaagctgtcactttgtgtatttgaaaactgaaaataatgtacaaataaactgatagagttaaattaatttcaattctatcaacaagtcaaacgaggtcacagctcaacatgcaaaaattaattgtatttatgtatacaaccaacatttttttaaaaaattataaaatatccttttctgtagcatcaaaacatgagtaccgtaaaataaatacaacaaaatatgtgcaaaacctgaagacaaaaaaccaatatgaatgattaagataaattaaagaagaccaaaactggtgggttaagataacatagttactgattgaaaaaatcaatatggtaaatgtgttaattctccccaaactgataaaacattca

SEQ ID NO: 13770 - DNA, 84 bp, Homo sapiens
cacagtcataacagcaatagctcacctaagtttttcagtagtcatccttatcattaaattaatcagggaatgttcacattcctt

SEQ ID NO: 13771 - DNA, 456 bp, Homo sapiens
aaaaacctgactcatcagtgctggtgtgactcacaggccaacaaaactggcttgccagactggttgggaggggaacctgctgctgccaccataactcggggctgtgggcaggtaaagcccatccctccatccctctggctgtagaggacgcatcctacccaccgccagatgcagggcctgggtggtgggcctggctggggcaccactctcagcctgacccccgccctggaacagccacagctgcttcaggaacttattagcgaggggcggagctgggagggaagacaactcaggggctttggaacacagagaggtggctttaagaatcagagaggaggccgggcgtggtggatcatgcctgtaatcccagcattttgggaggccgagacaggtggatcacctgaggtcaggagttcgagaccagcctggtaaacatggtgaaactccatctctact

SEQ ID NO: 13772 - DNA, 489 bp, Homo sapiens
ggggtttattttttgagcaaaatggtcatttgccaagaagttctcctgtcagaagttctccagaaaattccaagacttacctgggaacaaaagaaagcctgctagcccagaaatgagaattttaattttgatcagctctcaggagatctgtgggaacctcaatttgctcagtgtctttgaaacactgcagtcttgtgtatactgagtgggtggccatggtagtgtgccatacacaggtgcaataaaaaatagcttatcaactcctgacttcaggtgatcctcccgcctcagcctctcagccttgccaacatggtgaacctctgtctctactaaaaatacaaaaaattacctgggcgtggtggtggacatctgtaatcccagctactcgggaggctgaggtgagagaatttctggaacctgggtggcagaggttgcagtgagctgagattgcaacattgcactccagcctgggtgacagagtgagactct

SEQ ID NO: 13773 - DNA, 83 bp, Homo sapiens
tttctcaaaaaaattgatctgcaaaatggcgatggtaaatgctgcacagcagtgatgaacatggtaaatcatcacgtatgatg

SEQ ID NO: 13774 - DNA, 531 bp, Homo sapiens
  misc_feature 437: n = A,T,C or G
ccaagtacccacactcttgtgaagtctcctcccacacgcactataccagggttagtctgtttgaacaatagcagatgtggaagtgatggtaagtcatttctaagattagactttgaaagagtataatttccacgttgagctctcttgttctctctgtctctttgtgtctttgtcgctctctctctctctgatctattgctggaaaagaggagtgagaaggggaaaggagtgaaaaacaagttgctatattgtgaacagttctatggagaggactgcacggtaaaaaaaaaatggagcctccagccgggcgcggtggctcacgcatgtaatcccagcactttgggaggccgaggtgggcggatcatgaggtcaggaaatcaagaccatcctggctaacatggtgaaatcccgtctctactgaaaatacaaaaaattanctgggcgtggtggcgggcgcctgtcatcccagctactctggaggctgaggcaggagaattgcttgaaccccggaggaggaggttgcggtgagcc

SEQ ID NO: 13775 - DNA, 463 bp, Homo sapiens
tacggctgcgagaagacgacagaagggaaagatgtagatgcagacatgaaaatgcatgcaaatacatacacatgtagataaatatagataaagctatcaaaggcatcttcctttcaatcttcttttgagtataattcggaatttatcctgagaaatactgataaaatatagggctaggcaaatataatttgggatgctgtagagtgttattagtagaaacgacttctcttttctgagccttgtgaaatagctttcaaggggcagctggtagtgatttaagggcagtcacagagacagccaattagagttaatcagtcattatatttacagcatcagactatcatgcaatacaaaacggatgccgacttgaccttttcatcccctatatttccttccccatctcaaacagcagccaatcttatgcaattggcttcattatgaataatgggaagcatcttacatt

SEQ ID NO: 13776 - DNA, 553 bp, Homo sapiens; identical to SEQ ID NO: 9077

SEQ ID NO: 13777 - DNA, 180 bp, Homo sapiens; identical to SEQ ID NO: 9079

SEQ ID NO: 13778 - DNA, 554 bp, Homo sapiens
taatttaaaaagttttctataattataggctacatgctttcttaggtgaattctatcaaacatttaagaaagtacagagaatcctcaacttacagtggtttgacttgtgctcttctgacttgataatggtgctttcatctgtgtacattaatgatgagcatcaatatgaccagtttttcactatcagtatagttttcaataaatttcatgagatactgaatattttaaaatgggccttgtggtagatgattttgcccaattgtaggataacgtaagtgttctgagcaagtttaaggtaggtgaggctaagtcatgatattcagtaggttaaatatattaaatgcgttttagacttacaatattttcaatttaggatgagttcattaagacataagacaattgtaagttgaggagtatctataatatcaatcttgaacggactctttttaagaaatagaatttaagggccgggcacagtggctcacacatgtaatcccagcactttgggaggccaagatgggcagatcacctggggtcaggagtttgggaccaac

SEQ ID NO: 13779 - DNA, 95 bp, Homo sapiens
taacaaatttgtcatcccaagtggaagaaaactggacccatttgcaatcactcttaaatcaaagcatgtgtattttaaattatctcaaaagtgct

SEQ ID NO: 13780 - DNA, 524 bp, Homo sapiens
ggcacgagatttgttgggcctgggctactgctcaccctggttaggtgagcctctaggaaaacttaaaacaaattttaagccaggtatggtggcacatacctgtggtctcagctattcaggaggccaaggcaggaggatctcttgagcccaggagtttgagaccccatctcaaacaaaaaatacaaaaattagccagccacggcgcctgcacttccagctcctttgagagactgaggcaggaagattgcctaagcccaggaggccaagtctgcagtaagctatggtaacaccactgcactccaacctgggcaacagagggagactctgtctctaaaaaaatagaaaaatttgccctgcatggtggctcacgcctgtaatcctagccctttggaaggccaaggcgggcagatcacttgaggtcgggagttcgagaccagcctgaccaacatggagaaaccccatctgtactaaaaatacaaaattagctgggtttggtggcgcatgcttgtaatcccagctactcg

SEQ ID NO: 13781 - DNA, 498 bp, Homo sapiens
ggcacgagggtttaatgagccctgtccagggcccttcagtggggagcctccttcttcttgcccttctccttcttgcccttctccttcttcttcactttgggcttcttggccttgcccgggatgctctcgtgctgcttggagccagcagcgtgggactgtggggccgagggcagggatgggagagaagagatggttctgggctggaagcgagacagggggaccactccccgcaccctccccgccagccccagtgcggggacgcctctctggggtgcagggcacgtgcttggggacgctggcgagagccccttaccttcacatccgtgtccgaatcgctggagctgctgctggagtcggaagagctgtggtgtccttgctggatggaggtgcggcagtgaggcggcgccccttacccagccccctgaagttggaggcctaaggcaggaccctggggtcaggggcaaccccagccttcccgcccctccgcagccggtgatg

SEQ ID NO: 13782 - DNA, 585 bp, Homo sapiens
ggcacgagagagaaacaagggagacaagggtgcccagacaggtgcggggctcagccaggaggcagaagacgtggacgtgtcccgggccaggagggtcacagatgcaccacaaggcactctgtgtggcactgggaacaggaattctgggagtcagtctgcaagggcggtgggcgttgctcacctgggagaagcctttagagtgggcgttgagcaggccattagctcgtgccctgaggaggtgcatgggcggcatgggctctccatggaaattatgtgggcgcaaatggatgtggctctgcgctcacctgggcgaggacttctggccggtgccggggcactctgcatgaccctggcagaatcgagctgccctgactatgaaaggggaagaagagcatgcctgaccctccaccggcaccccacccctcactgctccacctggggcctgcctctgcgggtggctgggtcctggctgactgttgtgactgttgaggccctggggcggtggcgcatgggagttaggaggactggccaggtggggaccactatgcacccacccccagtgtcaggtgcttctcctctcctcct

SEQ ID NO: 13783 - DNA, 576 bp, Homo sapiens
ggcacgagggatggacttcgtgtagatctgctgacgatcacttcctgccatgggcttcgagaagatcgagagccccgtctagagcagctatttcctgataccagcacccctcgaccattccgtttcgcaggcaagaggatattcttcttaagcagtagagtacacccaggggagactccatctagctttgtcttcaatggctttctggacttcatcctccgacctgatgatccccgggcccaaaccctccgtcgcctcttcgtctttaagctgattcccatgttgaaccccgatggtgtggtccggggacactaccgcacagactcacgtggagtgaatctgaaccgtcagtacctgaagcctgatgccgtcctgcacccggccatctatggggccaaagctgtgcttctctaccaccatgtgcactctcgtctgaactcccagagttcctctgagcaccagcccagttcctgtctccctcctgatgctcctgtttctgacctggagaaagccaacaatctccaaaatgaagctcagtgtgggcactcagctgacaggcataacgctgaagcctgg

SEQ ID NO: 13784 - DNA, 388 bp, Homo sapiens
  misc_feature 190, 271, 353: n = A,T,C or G
gacacaaatacacaaggaaagctccatggaagataaaggcagagatttacaagccaaggaatgtcaaagacggccagcacaccaccagaagctagcagagaggtatggaacagattcttcttcacaacctcagagggaaaaccctgctgatacctggatttcaaactcctggcctccagaacgagacggngttttaccacgttagccgcgctgggcttgaactcctgacctcaggtgatccacccgcctcgatcgccattataacaatcanatggctgtcttcatggactggtacaaaacagaatatacaccatggacagacagaggctcagaacacacacactctacaccantgatcttgcaacctgacaaacagcatgagaaggac

SEQ ID NO: 13785 - DNA, 380 bp, Homo sapiens
ggcacgagatgtgatgatagtaactctgaagcttatgtctgtagcttttgcagtgttcacaggttggagacttaaacttttttaagtaacatagttcagttgtttttttttttggaatatatccttggcagttgggaggactttttccaaagggcaaaggggagttgaagttttacttgcctttgcttattaccattactttttccccaaggaatgaacatactgattcctttttctcctcctccaagctcccaaaacaaaggttaaacagtcttgggctatttttagttggagcttgcctaatcaaggaatttttttataaaaaaatttaaaagttcaacattagtaatcgtattatttttaccccatttttttttgac

SEQ ID NO: 13786 - DNA, 283 bp, Homo sapiens
cctggagagccttatcatgtattttatatgcttatgtggtgttggatgacatcatggaccatatagcttttatagagaatttttctcaccatagaactgaggtctcaccaggtgatctactatgcaaattcctacagttttctattcttaagaaataagggccgggcacggcggatcatgaggtcaggaaattgagaccatcctggctaacacggtgaaaccctgtctctactaaaaatacaaaaaaaattagccgagcatggtggcgggcacctgtagtccc

SEQ ID NO: 13787 - DNA, 402 bp, Homo sapiens
  misc_feature 270: n = A,T,C or G
aaagatgaagcttaacactgaggtgagagagattggacctttgtcaaagaagggattctatcttgcctttcaggatgtaggggcttgcatagctttggtttctgtcaaagtgtactacaagaagtgctggtccattattgagaacttagctatctttccagatacagtgactggttcagaattttcctctttagtcgaggttcgagggacatgtgtcagcagtgcagaggaagaagcggaaaacgcccccagggatgcactgcagtcagnaaggagaatggttagtgcccattgggaaaatgtatctggcaaagcaggcttaccagcaaaaagggagacactttgtggaaccctgtgggccgtggggttcttacaagtctttcctcttcaagatctttcagt

SEQ ID NO: 13788 - DNA, 567 bp, Homo sapiens
  misc_feature 547, 548, 549, 550, 553, 554, 556, 557, 558, 559, 560, 561,562, 563, 564: n = A,T,C or G
ggggttctccaaggaagttctgtagcctcagtgtatgatgggaagctgctcataggcactttataccacagagccttgtattgtgaactctaaattgtacttttggcatgaaagtgcgataacttaacaattaattttctatgaattgctaattctgagggaatttaaccagcaacattgacccagaaatgtatggcatgtgtagttaattttattccagtaaggaacggcccttttagttcttagagcacttttaacaaaaaaggaaaatgaacaggttctttaaaatgccaagcaagggacagaaaagaaagctgctttcgaataaagtgaatacattttgcacaaagtaagcctcacctttgccttccaactgccagaacatggattccactgaaatagagtgaattatatttccttaaaatgtgagtgacctcacttctggcactgtgactactatggctgtttagaactactgataataacgtattttgatgtttgactacatctttgttaccattaaaagtggagtatattaagactactnnnnaannannnnnnnnngga

SEQ ID NO: 13789 - DNA, 529 bp, Homo sapiens
tgacactatagaacaagtttgtacaaaaaacaggctggtaccggtccggaattcccgggatatcgtcgacccacgcgtccggggacttctgacctgctggccagccaggacctgtgtggggaggccctcctgctgccttggggtgacaatctcagctccaggctacagggagaccgggaggatcacagagccagcatggatcctgacagtgatcaacctctgaacagcctcgatgtcaaacccctgcgcaaaccccgtatccccatggagaccttcagaaaggtggggatccccatcatcatagcactactgagcctggcgagtatcatcattgtggttgtcctcatcaaggtgattctggataaatactacttcctctgcgggcagcctctccacttcatcccgaggaagcagctgtgtgacggaaagctggactgtcccttgggggaggacgaggagcactgtgtcaagagcttccccgaagggcctgcagtggcagtccgcctctccaaggaccgatccacactgc

SEQ ID NO: 13790 - DNA, 608 bp, Homo sapiens
  misc_feature 188, 189, 496, 521, 526, 599: n = A,T,C or G
ttatacagagaaattcggaataccaggaacttaacttacatagaccctgatgccctcaaagagctccccctcctaaagttccttggcattttcaacactggacttaaaatgttccctgacctgaccaaagtttattccactgatatattctttatacttgaaattacagacaacccttacatgacgtnnatccctgtgaatgcttttcagggactatgcaatgaaaccttgacactgaagctgtacaacaatggctttacttcagtccaaggatatgctttcaatgggacaaagctggatgctgtttacctaaacaagaataaatacctgacagttattgacaaagatgcatttggaggagtatacagtggaccaagcttgctgctgcctcttggaagaaagtccttgtcctttgagactcagaaggccccaagctccagtatgccatcatgatgcctgctaaggaggcccaccttggtgtacatggctcacagangctctgttcatggagcagctgctgnttganaaattttgaaatgcaagatccacaactagatggaaggcatctgtctttgcagaaaaaatggtcctgaatgtcntggcccaag

SEQ ID NO: 13791 - DNA, 441 bp, Homo sapiens
tccaccgcggtggcggccgctctaaaactagtggatcccccgggctgcaggaattcggcacgagcggcacgagtgcacacggcgccgctactggccgccgccggcctccacgccgcgcctatggccgccgagcgcgccgtggctttcatggaccaggtgcgcgccttccaggagcaggtggacaagctgggccgcctgcaggtcgactcggccgagtatggctgcctcaaggccatcgcgctcttcacgcccgacgcctgtggcctctcaaacccggcccacgttgagagcctgcaggagaaggcgcaggtggccctcaccgagtatgtgcgggcgcagtacccgtcccagccccagcgcttcgggcgcctgctgctgcggctccccgccctgcgcgcggtccctgcctccctcatctcccagctgttcttcatgcgcctg

SEQ ID NO: 13792 - DNA, 781 bp, Homo sapiens
  misc_feature 26, 553, 586, 631, 649, 678, 689, 701, 713, 721, 727, 733,745, 750, 763: n = A,T,C or G
agtggtgcgccaacgtgagtacgagnacccgtgcgcggctgcgctttcctgtccccaagccgttctagacgcgggaaaaatgctttctgaaagcagctcctttttgaagggtgtgatgcttggaagcattttctgtgctttgatcactatgctaggacacattaggattggtcatggaaatagaatgcaccaccatgagcatcatcacctacaagctcctaacaaagaagatatcttgaaaatttcagaggatgagcgcatggagctcagtaagagctttcgagtatactgtattatccttgtaaaacccaaagatgtgagtctttgggctgcagtaaaggagacttggaccaaacactgtgacaaagcagagttcttcagttctgaaaatgttaaagtgtttgagtcaattaatatggacacaaatgacatgtggttaatgatgagaaaagcttacaaatacgcctttgataagtatagagaccaatacaactggttcttccttgcacgccccactacgtttgctatcattgaaacctaaagtattttttgntaaaaaaggatccatcacagcctttctatctangccacactataaatctggagaccttgatatgtgggtatggaagangaattgtcttaagtgtanaatcatgaaaagacttacagcctttcatntcccaaaaagngtctgacagganggatgattgganattttganaaacanctacanttgcctgaattnctgantttgcaaaatgcnaaatctgtggaaaatttt

SEQ ID NO: 13793 - DNA, 830 bp, Homo sapiens
  misc_feature 437, 441, 443, 573, 600, 648, 679, 699, 713, 733, 760, 776,807: n = A,T,C or G
agagcacaaggagcctccagcctgccctgtggacataccaccccccagcttggcctccccaccagcccgctgagcaggctgccacccccgatgctgagcctcacagcgagcctcctgatcaccaggagcgccctgccgtccaccgtgggatccgctacctgttgtacagagcacagagagccatccgccttcgccatgccctccgcttgcaccctcaattgcatcgggcccctattcggacttggtctccccatgtggtccaagccagcactcctgccatcacagggcccctcaaccatcctgccaatgcccaggaacatcctgcccagctgcaaaggggcatcagcacccccaccggatacgaggggctgtggatcccgcagccgctccctccgggctcctcccatttatcccagtggctcaacaacttttttgcnctcncnttctcctccatggcttcccagcttgacatgtcttccgtggtgggggcaggggaaagcagagcccagactcttggagcaggtgttcccctgggaacttctgtcagaggctccatggaggcctctcaagtcnagtgcttctggaagcctctccaattanattccaacaacctgtgccccagaaaggccccccattaagccaattccnaggggccgtcaagaaggctttgagagtgtanctttcttgtaacttgcagcnaaaaccttgccggncctgagttgcttcttcagcnaatgttttaaaggcttgaaagatagantcattattctggtaangatggattaacgatgaatggtatgattgacnttggaaggaaattgggtttcctg

SEQ ID NO: 13794 - DNA, 437 bp, Homo sapiens
aatccataggtgccatcgtggttgagacaagtgcaaaaaatgctattaatatcgaagagctctttcaaggaatcagccgccagatcccacccttggacccccatgaaaatggaaacaatggaacaatcaaagttgagaagccaaccatgcaagccagccgccggtgctgttgacccaagggccgtggtccacggtacttgaagaagccagagcccacatcctgtgcactgctgaaggaccctacgctcggtggcctggcacctcactttgagaagagtgagcacactggctttgcatcctggaagacctgcagggggcggggcaggaaatgtacctgaaaaggattttagaaaaccctgggaaaacccaccacaccaccacaaaatggcctttagtgtatgaaatgcacatggaggggatgtagttgcatttttgct

SEQ ID NO: 13795 - DNA, 589 bp, Homo sapiens
caacatttgtctacaactctactgtaaaattggaaatgcttttccacagaaaaacctctcaaaatgctgaatgcaaaagttgggatcacagaaacattgtgcctatttttggtctgctggaaactgtatttttacaaggtaatccctgttttcaatatagttcctgtcttgccactggcggttttcttgtagcatttttctagttctgagattgctactacccaaagtattcatttctttcttactggggtgtcctctgtcttcacagcctgcttctggattgtaggttttttcctttctttctgttgagatatttatggcatttgatagagtcaaaccagatgtattgcagccggacatacttatgtggcttcagatgtgtaaaataagtaacttcctatctttgtctgtctagctcaagagttgactgtggacgaggaatgcctgtattgattcattaatgtaataactatttactgactgcctaccatgtacaaccagaaacacagttcctaacctcatgaacttaccatgtaacatgggaagacaagcactaagttcttatttgtttgtaattgtgataaggctc

SEQ ID NO: 13796 - DNA, 156 bp, Homo sapiens
tgatcagaaagctggggactcacaaattttaccaaaaatcaaacctattcctcagctccacggctacctgcgatctgtgtttagctctgacgaatggaattgatcctcacaacattggtgttctaaatgtcttaagaacctaattaaatagctgac

SEQ ID NO: 13797 - DNA, 459 bp, Homo sapiens
  misc_feature 160: n = A,T,C or G
cgactcactatagggaagctggtacgcctgcaggtaccggtccggaattcccgggtcgactactactactaaattcgcggccgcgtcgacgcagaatggctcccgcaaagaagggtggcgagaagaaaaagggccgttctgccatcaacgaagtggtaancccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaat

SEQ ID NO: 13798 - DNA, 71 bp, Homo sapiens
tggtacgcctgcaggtaccggtccggaattcccgggtcgactactactactaaattcgcggccgcgtcgac

SEQ ID NO: 13799 - DNA, 702 bp, Homo sapiens
  misc_feature 514, 635, 638, 675, 677, 679, 695, 698: n = A,T,C or G
gggcttctgggcaatgccaagcccaggtacttctacacatctgcctaacttgggaatgaatgtgggagaaaatcgctgctgctgagatggactccagaagaagaaactgtttctccaggcgactttgaacccattttttggcagtgttcatattattaaactagtcaaaaatgctaaaataatttgggagaaaatattttttaagtagtgttatagtttcatgtttatcttttattatgttttgtgaagttgtgtcttttcactaattacctatactatgccaatatttccttatatctatccataacatttatactacatttgtaagagaatatgcacgtgaaacttaacactttataaggtaaaaatgaggtttccaagatttaataatctgatcaagttcttgttatttccaaatagaatggactcggtctgttaagggctaaggagaagaggaagataaggttaaaagttgttaatgaccaaacattctaaaagaaatgcaaaaaaaaantttattttcaagccttcgaactatttaaggaaagcaaaatcatttcctaaatgcatatcatttgtgagaatttctcattaatatcctgaatcattcatttagctaggcttctggtgactcnatntgcatctaggaagtctatttctggccaactgtgctantngnaagcttccttagtgtnaanttac

SEQ ID NO: 13800 - DNA, 530 bp, Homo sapiens
tcggcacgaggtacgtggccactaggtggtacagggctcctgagacatgctgaactggatgcattacaaccagacagttgatatttggtcagtgggatgcataatggccgagctgttgactggaagaacattgtttcctggtacagaccatattgatcagttgaagctcattttaagactcgttggaaccccaggggctgagcttttgaagaaaatctcctcagagtctgcaagaaactatattcagtctttgactcagatgccgaagatgaactttgcgaatgtatttattggtgccaatcccctggctgtcgacttgctggagaagatgcttgtattggactcagataagagaattacagcggcccaagcccttgcacatgcctactttgctcagtaccacgatcctgatgatgaaccagtggccgatccttatgatcagtcctttgaaagcagggacctccttatagatgagtggaaaagcctgacctatgatgaagtcatcagctttgtgccaccaccccttgacc

SEQ ID NO: 13801 - DNA, 730 bp, Homo sapiens; identical to SEQ ID NO: 268
  misc_feature 570: n = A,T,C or G

SEQ ID NO: 13802 - DNA, 585 bp, Homo sapiens
cgtcttaaaatatatttaggaaatgtaaaattaaagattaaaaattttattctatgcaacataaaataatatgcataaatctggcacataatttctttgtttttactttagaaaaaagacagtaagaaaaaagtttataaatttctcagtcccttttatacaaagttgcaactaaaaccagcaatcacttatatgtacaaccatcaactctgaatacaatgtgaattatacctaggaactgtaatttacctagatgagttctgcctgctttatgaaaaacacacacttatatcacagaacaccgtggcttctacaatttgtaacaattttgaaaacgaaactcctgcctccataatataaggaaacaagagtactctttccatagtcatcatcctgtataaaaaaacttcatagtctgatttacctttgtcaaaggtaaaatgattcacatttgcttggattactctgatcctcagtagttcctaaacacaaaataaagtttgcatgaacctttatctggttttccaaagcaagtattatgctggcagaagtccatgagctgaataaaaagatactaaatataaa

SEQ ID NO: 13803 - DNA, 475 bp, Homo sapiens
tggttcatggctatctggtgatgttggaataggagaggtatccatgggttcagactcttcagttgacacctccactacagtttctgtaatgacatctggcctcatagcagcatggatgaattcaggacttcttgaatccctcaagcaggtaggagattccatatgaagcagggcttcagcagcttcaattgtcttatctgtacagtgtgcattactgctgtgaactgatgcttccactgtttccacattctcggtctcaacttcttgttcttctgccacatcttgcatcatataagtctcatcatcataaaccagaacctgggctgcatagccctgctctaatctggcacttggaactggctccacaatcactgctggatattcagaaaccttttcactttcctcttgattttctactccattgctggaaagctccaaaatagtacctccactgtcaaccactgctgatgtcatt

SEQ ID NO: 13804 - DNA, 375 bp, Homo sapiens
gggccactctggatcctgggcgacgttttcatcggccgctactacactgtgtttgaccgagacaacaacagggtgggcttcaccgaggctgcccgcctctagttcccaagacgtccgcgcgccatcacaaaaacagaggaaagtcccataccaggaggcccctggcccagcggcccctcccacacacacccacacactcgcccgcccactgtcctgggcgccctggaagccggcggcccaagcccgacttgctgttttgttctgtggttttcccctccctgggttcaaaaatgctgcctgcctgtcccccccaacacctgagccaggtgaagggccccgtaaattggaaggatgcacaagttccaaggttacgtt

SEQ ID NO: 13805 - DNA, 486 bp, Homo sapiens
ggtcgacacctggccgtggacacctgtgtcagcatgtgggacctggttctctccatcgccttgtctgtggggtgcactggtgccgtgcccctcatccagtctcggattgtgggaggctgggagtgtgagaagcattcccaaccctggcaggtggctgtgtacagtcatggatgggcacactgtgggggtgtcctggtgcacccccagtgggtgctcacagctgcccattgcctaaagaagaatagccaggtctggctgggtcggcacaacctgtttgagcctgaagacacaggccagagggtccctgtcagccacagcttcccacacccgctctacaatatgagccttctgaagcatcaaagccttagaccagatgaagactccagccatgacctcatgctgcttcgcctgtcagagcctgccaagatcacagatgttgtgaaggtcctgggctgccacccaggagccagcatggggacagctgct

SEQ ID NO: 13806 - DNA, 644 bp, Homo sapiens
tccaccgcggtggcggccgctctagactagtggatcccccgggctgcaggaattcggcacgagagatggtggctgagctgtgggctcacgaccccgaccccggcccgggggtgagcgccgggctccgtggggaggaagcgggggccaccaagggacagaagatgagcctgtcggtcctggagggtatggggttccgtgtgggccaggctctaggcgagaggctgccccgggagacgctggccttcagggaggagctggatgtcctcaagttcttgtgcaaagacctgtgggtggcggtgttccagaagcagatggacagcctgcgcaccaatcaccaggggacctacgtcctgcaagacaacagcttccccctcctcctcccgatggcctctggcctgcagtatctggaggaagcacccaagttcctggccttcacctgcggcctcctgcgcggcgccctctataccctgggcattgagagcgtggtcaccgcctccgtggcagccctgcccgtctgtaagttccaggtggtgattccgaaatcctaagcctgcctcgcacctgctgagccgcactgctgcccctggcctcaccggcctcaggagacggtggggccgctgcatttcggggtggtcttgggaatc

SEQ ID NO: 13807 - DNA, 457 bp, Homo sapiens
  misc_feature 11: n = A,T,C or G
aggggcaaggnacagcttttggtatgctaaagaatttgggaaagatgctgttggtgtaggggcggggagactagaaacaagatctttccatgggcagagctcttcagagcttgataacaaagtttggtctgcagcctttgtcaaataattataaactctccagttgaaacagggaaatgtgggctggcgtggtggctcacacctgtaattccagcactctgggaggctgaggcaggtggatcacttgaggtcaggagttcgagaccagcctggccaatatagtgaaaccccatctctactaaaaatacgaaaattagctgggtgtggtgatatgcacctatagtcccagctactcaggaggctgaggcaggagaattgcttgaacccagaaggtggaggttgcagtgggctgagatcatgccaacacactccagctgatagagtgagactctatttc

SEQ ID NO: 13808 - DNA, 568 bp, Homo sapiens; identical to SEQ ID NO: 10622

SEQ ID NO: 13809 - DNA, 479 bp, Homo sapiens
  misc_feature 322, 335: n = A,T,C or G
gctttggtggcccagcggctggaacagctggtccaagagcagctgaaatctccgcccagcccagaattacagggtcccccatcgacagagaaggaagccatactgcggaggctggtggccctgctggaggaggaggcagaagtcattaaccagaagctggcctcggaccccgccctgcgcagcaagctggtccgcctgtcctccgactctttcgcccgcctggtggagctgttctgtagccgggatgacagctctcgcccaagccgagcatgccccgggcccccgcctccttccccggagcccctggcccgcctggccctanccatggagctganccggcgcgtggccgggctggggggcaccctggccggactcagcgtggagcacgtgcacagcttcacgccctggatccaggcccacgggggctgggagggcatcctggctgtttcacccgtggacttgaacttgccattggactg

SEQ ID NO: 13810 - DNA, 784 bp, Homo sapiens
tgagaggaaaaaaaagcccactggaattgtctaaactgcaatgcaatctcttgctcatttaaaagatctcattttctaatcatgtgctttgagacatttaatactatttcaattatgcagaggaaataatataattcctttatttgaaaaatgatactgaacctcagagatcagttaaatctactgctggaatggggattctttctaaaccgtgttgttccctctcttcaaacagctggagctgtacacagatggaaaaacatttggtcagaaagcagcaaattagtgtttttcaggaccgaattcggctcccgcagctcctgcatctccattcgtctagattttatttcttctttgcattgacatttttgcagacccagttcatgccatcctgaacgccctcttctgtgagagctgagcaagactggatctgccagactcggtcgcggatggtatgcaggttcagtccttctgcaatttcagaggcaggggctgctgtgagcaaatcctgcttattagcaaagatgagcactggcacacaacttagtttttcttcctccagtaattccgctagttcctgacccgtctcttcaaatctttttctgtctgcactgtcgattacatatataagaatatcggtattttcaaaataattcttccagtatggtctgattttcctctgtccaccaatgtcccatacattcagtttaaaaccttgtgattgtacactttttatgttgaaaacccttgtgtagggtgtatggtggctgatgtcctcaaatgc

SEQ ID NO: 13811 - DNA, 434 bp, Homo sapiens
tttaaacagactaatttatccattagttctatccaagatgtatctggaacatctcattaatgccttctccagtttgtgctgaagtttcaaagtacaggaaccctttgctttcagcccaaagacgtccttcactttcatctacacagcgatgtttggtacaatcaatcttgttggcacaaactacaaatataatattttccatgtttccatgaggtccaagctcttgcttcatttctgccagccacgcatcaagggcgtcaaaggagtctttctgcccaacatcatagaccagtatcacaccctgtgtgtccttgtaaaactcatttcgaactagttttgtgatcttgggcaagtcacttaacctctctgcgtctcagtttcctcatctcatagaagaagggatgtccagccatatcaaagatgttaactttgat

SEQ ID NO: 13812 - DNA, 526 bp, Homo sapiens
acaagctacttgttctttttgcaggatcccatcgattcgccaatggatgcaggacatctgagatgggatggccgcacgttgcccaggctggtctcctgagctcaaagcaatccagattgctgggattacagctgcgagccaccgggcctggctgaaatgacttttaaaaaaagacttctctaaagtagaaggaagggtggaattgtatgcacaagatgaacaaaacctggcaagaaaaacatactaaacacgctggagtgcattggcgcgatcttggctcaccgtaacctccgcctcccgggttcaagtgattctcctgcctcagcctcccaggtaactgggattacaagcatgggccaccacgcctggctaattatgtattgatagtaaagacggagtttctccatgttggacacgctggtctcgaactaccgacctcatgagatccacccacctcagcctcccacagtgctgggattacgagcatgagccaccgtgcccggcctccctggaccagacttctata

SEQ ID NO: 13813 - DNA, 317 bp, Homo sapiens
gaccactttgtacaaaaaagctgggtacgcgtaagcttgggcccctcgagggatactctagagcggccgccctttttttttttttatcataaaaataggctggaacagaaacaactgcttgggtaccctaaaaggataaaaaataattaagggtttggccacatatttaaacccttattaaaataacagtctggccagccgggggcttttgcctataatcccaccactttggaaggctgaggcagaagaatcacctgagggcaggatttcaaaaccaccctgggcaatggggaaaaaccctgtctttcctgaaaatt

SEQ ID NO: 13814 - DNA, 557 bp, Homo sapiens
  misc_feature 399, 449, 524: n = A,T,C or G
agtagagacagggtttcaccatgttagccaagatggtctcgatctcctgacctcgtgatccgcccacctgggcctcccaaagtgctgggattacaggcgtgagcccccgcacccggccaaaggcaggattatttgttaagcgggttgcagtgttctaccagaccccccaccctcaacccaagcccctggtctcactgggacttggccactgccaggagcgtctggcccttcacggcttcaggcccagcacagcgcgtgtcattctgggaaaacatcttgtctttttgggcctgaagccaacgatagaggtcgctcaggttctggtcacagatccaggggttgccggagatgtcgaagccatcccgcatgtcccagtttggctgccctagggatgcccanagcccctcgggcacgctggccagtgagttattggagaggtccagcatgtncagctgccgcaggccctggaaggcaccggctgccaccctggccagcttgttgccgttcaagaagaggtagcgcangtcctgctgcggcaagaggagatcttttcccag

SEQ ID NO: 13815 - DNA, 99 bp, Homo sapiens
tgacactatagaacaagtttgtacaaaaaagcaggctggtaccggtccggaattcccgggatatcgtcgacccacgcgtccgaccacgacgtacggccg

SEQ ID NO: 13816 - DNA, 230 bp, Homo sapiens
acaagtttgtacaaaaaagcaggctggtaccggtccggaattcccgggatatcgtcgacccacgcgtccgcccacgcgtccgcccacgcgtccgggcctctgagcaagacagtgcgcttcaacgtgctcaaggtcaccaaggctgccggcaccaagaagcagttccagaagttctgaggctggacatcggcccgctccccacaatgaaataaagttattttctcattccc

SEQ ID NO: 13817 - DNA, 238 bp, Homo sapiens
  misc_feature 1, 10, 26, 65, 86, 103, 104, 108, 115, 117, 128, 143, 157,199, 203, 205, 211, 231, 236: n = A,T,C or G
ngggtccggntgccgagaagacaacngaagggagctcactgcagtctcaaattcctgggatcaanaatcttcctacctcacccctnccactagctaggacttnngccntgccccncnctgctaatttntttctgagatggatntgttttgttactgnctaactctggcttacatctctgcttggctccaagtctggatnagtngnccctgntcactttttttttttttttnggttngc

SEQ ID NO: 13818 - DNA, 677 bp, Homo sapiens
  misc_feature 409, 537, 539, 540, 541, 569, 570: n = A,T,C or G
ccactcagctaagaggtatttattcagttgctggcacctctcccagtgtaaatctggacttggctccagagaaggtgtttcattacagcgggggcttagtttgcttcctgtagttagtagcgtttcatggttttctttatccagtgtacaaagcttgagactttggtgcaggctcgtggaggcatgccattgtttcgtccataggagacaatgccctgggccaccttgttacacacaagagggcctccagagtcccccttaaaggaagtctttttaatctctgggtcccccacgcacaactcaatggtactgtcgtaataatggcgtaagtcagattcgcactttcgatcttcctgcactgtcatcttcacctcttgtagtgtgtgtgatgttttccccaggggccgtntgcccccagccggccacactgcatgtctgccctggcttcacctgggccttggttgtaggtagcctgaggggctgcacagctcttgtccgctttgccctttctctccagcttgcagtagcatgatgtcntnnngagagtcttaggattataggctggatgnnggggagggctttcacagggataaacctgttgttcggctcttgtctttgatattgtggcccccaagtgaccattatgagcttccccacagtggcaacttgtaacacga

SEQ ID NO: 13819 - DNA, 745 bp, Homo sapiens
agtgggagaccacgttttattcagtccagttcaggatccccgctatctcagggctctctgggccagtcctcctgggagcccccaccacaacacttcccaggcatgagccctcaggggcccacatgagcttccacacactgagaagtgtccgagaaattggtggggcctctgaaggaggctgtgagcagcccacctgaactcccagctcaccagcccaaacagggtgcaggggctctggccctgaagaacctgagtggagtggaatggcactggctggccactcagctcagcgggcgacgtgcccctacaagttggcagaagtggctgccactgctgggtttgtgtaagagaggctgctgccaccattacctgcagaaaccttctcataggggctacgatcggtactgctagggggcacataacgcccatgggtgtggtaggtggggtactcgctcataggatggtaggtatcccgggctggaaagatgtccagctgcccgtagttctttcggcggcactgacagacagccaatgcaatgagatagacaatggccagcgcaaccagaacacagaccagcaccagcagcgcgatgccccagcctggcaccccagccccagactgagcagataaaagaatggcacatcactcacgctgacgtctgagatcgtcaagttatatcgagtagctgcttacgtgatatactgattggaaccgagctacacatcgagagacatgatggtgacc

SEQ ID NO: 13820 - DNA, 422 bp, Homo sapiens
  misc_feature 39, 48: n = A,T,C or G
gactagcagaagcacagctaggcccaatggccaccccangcactccanatttgccagttcaaattggtcctgctgggagaatctgcagtgggaaagtcaagcctggtattacgttttgtcaaagggcagttccatgagtaccaggagagcaccattggagcggccttcctcacccagtccgtttgtctagatgacacaacagtgaagtttgagatctgggacacagctgggcaggagcgatatcacagcttagcccccatgtactacaggggtgcccaagctgcaatcgtggtttacgacattactaatcaggaaacctttgcccgagcaaagacatgggtgaaggaactacagcgacaggccagtccctagcagcgttgttggcctggcagggaacaaagctgacctggccacgaaactat

SEQ ID NO: 13821 - DNA, 423 bp, Homo sapiens
agggggccctgcgcctgcgcggagctggagtccggctgggccgcagccgctgggagaccggcggttgccgtggggaccggtcgggcccctccctcctccggtcccccgccccaggtccttccccaccgagacgcgccggcggaccgcgggcgagtgcagccggtgacccggcgagaggcggcgccgctcccaagatgtcgcagacggccatgtccgaaacctacgattttttgtttaagttcttggttattggaaatgcaggaactggcaaatcttgcttacttcatcagtttattgaaaaaaaattcaaagatgactcaaatcatacaataggagtggaatttggttcaaagataataaatgttggtggtaaatatgtaaagttacaaatatgggatacagcaggacaagaacgattcaggt

SEQ ID NO: 13822 - DNA, 658 bp, Homo sapiens
caagctacttgttctttttgcaggatcccatcgattcgaattcggcacgagaaaagtcccccttctgggaaagaccgagtgaagaaaggtggatcctacatgtgccataggtcttattgttacaggtatcgctgtgctgctcggagccagaacacacctgatagctctgcttcgaatctgggattccgctgtgcagccgaccgcctgcccactatggactgacaaccaaggaaagtcttccccagtccaaggagcagtcgtgtctgacctacattgggcttttctcagaactttgaacgatcccatgcaaagaattcccaccctgaggtgggttacatacctgcccaatggccaaaggaaccgccttgtgagaccaaattgctgacctgggtcagtgcatgtgctttatggtgtggtgcatctttggagatcatcgccatattttacttttgagagtctttaaagaggaaggggagtggagggaaccctgagctaggcttcaggaggcccgcgtcctacgcaggctctgccacaggggttagaccccaggtccgacgcttgaccttcctgggcctcaagtgccctcccctatcaaatgaagggatggacagcatgacctctgggtgtctctccaactcaccagttctaaaaagggtat

SEQ ID NO: 13823 - DNA, 654 bp, Homo sapiens
tacttgttctttttgcaggatcccatcgattcgaattcggcacgagattatttccaaagcagcctacagtagaaaatagtcattatggcagcagcttctgatgtttttgtttggtaggttttctgatttcaatatatagaatcatattcatagagtatcttcttttaacgaattgcacaaagtacccatttaaaatttacatgcacagttcattgccacctttcttaggcctatgcatagttaataaggttataatctactcaacatggaaaatggagcctatttgcaaacacacaagtaattaaagtaccaattctctcttagtttctttttttatagttggtttattttgcaattataaatgttaaacatccctagagatgaaagttaaaatggttgatcacagatcagtagcaaaatacaaattgacaattcaaaattataaataaaactctgttgaggatgtttaactttgagtctccaaatttaagagctaagcttggaagaaacaaatttataggttatatttccctcttaaattaaaaaacaaacttcctctggcagtagtttgtgaattcctttcattgtaatgataccatgattacaggatcaaaaatgcttaacttacttgccattctgctcacatcatcacag

SEQ ID NO: 13824 - DNA, 578 bp, Homo sapiens
  misc_feature 363: n = A,T,C or G
tacgaatttaatacgactcactatagggaatttggccctcgaggccaagaattcggcacgagggttaccaatctgaagtgggagcaatacaaagcccatcacggctacaacagaaggactcagaaggaaatctttgtgaaacaagttaatattggccttgaataccatataagaataaaaagacagtcatttgtgttctcacttctcatattttagagtagagaatatgaagtgaacaatattttttttttaaaaaggaagggtctcaagactttttgctggaaatataaatgaaacagaaagcataaacacaactgaaagagttagtgtcattgatgataccaaggatattgagaagattancaatttgcagtggtgatggataggaagaggtgggtgctaaatttagtgttacatgtccatatgcaagtactaacaagttagaaatctggtagaacctacactgatttttttattgttgctgcaaatactcattgcaaacttagaagcttaaaataacaaaaatgcggccgggtgcggtggctcacgcctgtaatcccagcactttgagcatcttt

SEQ ID NO: 13825 - DNA, 201 bp, Homo sapiens
tatgacgtcgcatgcacgcgtacgtaagcttggatcctctagagcggccgcctactactactaaattcgcggccgcgtcgacctcttccgatgtttgtgtcacacaacactgatgtgacttttatatgctttttctcagatctggtttctaagagttttggggggcggggctgtcaccacgtgcagtatctcaagatattc

SEQ ID NO: 13826 - DNA, 349 bp, Homo sapiens
  misc_feature 102, 136, 276, 277: n = A,T,C or G
tttcaagaaggagggagaggttaccttgtcgagagcaaggtaggataaggttttaaaatggtagactcagccgggtgcagtggctcctgcctgtaatcccancactttgggaggctgtggtgggtggatcacctgnagtcaggagttcgagaccagcctggtcaacatggcaaaaccccatctctactaaaaatacaaaaaacgccgggcgtggtggcttgggcctgtagtcccagctacttgggaggctgagacatgagaatcgcttgaacccanngagtggaggttgcagtgagccgacattgcaccactgcactccagcctgggtgacagagtgagactctttctc

SEQ ID NO: 13827 - DNA, 249 bp, Homo sapiens
tggtcctagctactcaggaggctgaagtgggaggatcgctggagtctggaaagttgaggctgcagtgagccatgatcgtgccactgcactctagcctgggtgacagagtgataccctgtctaaaaaagcaagacaaaacaaaaaaaccccacttattttccttgtggccatcttggagattacaattaatatcttaaatgtattttaattaattaattaatttatttatttatttatttattttgagac

SEQ ID NO: 13828 - DNA, 643 bp, Homo sapiens
acagaagggactacagccttgttagatgacttggataaagaactaaacaactacattatgcgatgtagagaatggtatggctggcatttccctgaattaggaaaaattatttcagataatttaacatactgcaagtgtttacagaaagttggcgataggaagaactatgcctctgccaagctttctgagttgctgccagaagaagttgaagcagaagtgaaagcagctgcagagatatcaatgggaacagaggtttcagaagaagatatttgcaatattctgcatctttgcacccaggtgattgaaatctctgaatatcgaacccagctctatgaatatctacaaaatcgaatgatggccattgcacccaatgttacagtcatggttggggaattagttggagcacggcttattgctcatgcaggttctcttttaaatttggccaagcatgcagcttctaccgttcagattcttggagctgaaaaggcacttttcagagccctcaaatctagacgggatacccctaagtatggtctcatttatcatgcttcactcgtgggccagacaagtcccaaacacaaaggaaagatttctcgaatgctggcagccaaaaccgttttggctatccgttatgatgcttttg

SEQ ID NO: 13829 - DNA, 226 bp, Homo sapiens
  misc_feature 113, 123, 138, 194, 197, 203, 224: n = A,T,C or G
ggggtaattgctgacccaagaggaaacactctaggacggggaacgacaattacccttgtcttaaagaagaagcatctgattaccttgaattggatacaattaaaatctcgtcnaaaatattcncagttcataactttnctattatgtatggagcagcagactgaactgtgaggagcccttggggaagaaaagcnccnagaganaagaaaatctgtgtgaactgngt

SEQ ID NO: 13830 - DNA, 702 bp, Homo sapiens
  misc_feature 1, 8, 21, 55, 65, 81, 143, 149, 158, 203, 206, 207, 216,232, 240, 253, 309, 316, 330, 352, 366, 368, 401, 566, 598,601, 607, 616, 631, 648, 658, 670, 699: n = A,T,C or G
nagacagnaggggttattaanaatagctgttatttttaatagctatactaaaacntaaaaatgtntaggtcagggcgtggnggctcatgcatatcatcccaacaccttgggtaggatgaggtgggaggattgcttgaggccangagttngggatcagnctgggccactgacttttcaagctatctttgtctctggcccctctncanngcactcaangtccattgtccttagngctaagtnatggttggggatntttgctgaggatcagacaagggctcttggaggaaatggcggacccagactacattncatgcanctcaccatccttangagggagatggaatcttctgtntactaacacaccananaggtataatacaagggacaaaatgtggcaagtntcaactcttctgccttgacatgcaaaccatcccttctgagctcacttccatgcaccatgcacagtggattccatgaacccacttccatgctaccatttttgtttttgtaatcatttgcaaagagacagaatgatattaagaaagtatcagtggctgggcacaggnggtgacataaacctgtaattccagctactcangangctgangcaggaganaattgcctgaaccanggaggcggaggttgtantgagcaaaancacaccactgcnctccagcctggagacagaggagactctgnccc

SEQ ID NO: 13831 - DNA, 364 bp, Homo sapiens
tccaccgcggtggcggccgctctagactagtggatcccccgggctgcaggaattcggcacgaggctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctc

SEQ ID NO: 13832 - DNA, 153 bp, Homo sapiens
acaagtttgtacaaaaaagcagctggtaccggtccggaattcccgggatatcgtcgacccacgcgtccgcccacgcgtccggacccacgcgtccggtgagccgagatcaccccactgcactccagcctgggcgagagagcaagactcagtctc

SEQ ID NO: 13833 - DNA, 542 bp, Homo sapiens
actttgacaacaaattatattttaaatgtttcatatttacttttatatttccatacaatcagaaacagtaaaaaaaatttggagagcacataaaaacatcttaaagttaaaaatataaagccttgtatttaaaaatgcagtcatttaaataatattataagaatctatttgtacataataaacaagtttcaaccagcaagaaattactaatattgactgtggagttttggctgttttaatagttctaactcattattccgtaattcaacacagcactaccaacacagctggcaatgacaagactgggagtatcaaactaggattgttagttcaattaaaatttcagataaacaataatgtacttatactaaaaaattatttgttgtttatctgaaatgaaaatttaactgggtacccaattgtttgtttgtttaatctaaaaaccctgattgaaatttatctaataaaacatcatttaatatctaaaataaaataaatttactataacatctttataactattcaatcaatgattcatcttc

SEQ ID NO: 13834 - DNA, 495 bp, Homo sapiens
ttaggcctatttaggtgacactataggaacagtttgtacaaaaaacaggctggtaccggtccggaattcccgggatatcgtcgacccacgcgtccggtctcgcgctctgttgcccaggctggagtgcaatggtgccatttcggcttgctggaacctccgcctcctgggctcaagcgattctcctgcctcggcctcctgagtggctgggacttcaggtgcacactgccacacccgcataatttttttgtattttagtggacacagggtttcaccgtgttgcccaggctggtcacaaactcctgagctcaagccatccgcccgcctcggcctcccaaagcgctgggataacaggcgtgagcccccgcgcctggcttcttaattgttctaacagcagcgacaacaacaaaaacccagctctgagattccagccccggcgactctaacagtcccaggcccgatccctcacctacaaccgagatgccagccctgactcca

SEQ ID NO: 13835 - DNA, 651 bp, Homo sapiens
aagcttgcggccgctgtgcggaggccgctgaacagctgcagccgccgccgcgcagatccacgctggctccgtgcgccatggtcacccacagcaagtttcccgccgccgggatgagccgccccctggacaccagcctgcgcctcaagaccttcagctccaagagcgagtaccagctggtggtgaacgcagtgcgcaagctgcaggagagcggcttctactggagcgcagtgaccggcggcgaggcgaacctgctgctcagtgccgagcccgccggcacctttctgatccgcgacagctcggaccagcgccacttcttcacgctcagcgtcaagacccagtctgggaccaagaacctgcgcatccagtgtgaggggggcagcttctctctgcagagcgatccccggagcacgcagcccgtgccccgcttcgactgcgtgctcaagctggtgcaccactacatgccgccccctggagccccctccttcccctcgccacctactgaaccctcctccgaggtgcccgagcagccgtctgcccagccactccctgggagtccccccagaagagcctattacatctactccgggggcgagaagatccccctggtgttgagccggcccctctcctccaacgtggccactcttcagcatc

SEQ ID NO: 13836 - DNA, 506 bp, Homo sapiens
tatgacgtcgcatgcacgcgtacgtaagcttggatcctctagagcggccgcctactactactaaattcgcggccgcgtcgacgccgaccaagagccagggagccagatggtggaggccagcctctccgtacggcacccagagtacaacagacccttgctcgctaacgacctcatgctcatcaagttggacgaatccgtgtccgagtctgacaccatccggagcatcagcattgcttcgcagtgccctaccgcggggaactcttgcctcgtttctggctggggtctgctggcgaacggcagaatgcctaccgtgctgcagtgcgtgaacgtgtcggtggtgtctgaggaggtctgcagtaagctctatgacccgctgtaccaccccagcatgttctgcgccggcggagggcaagaccagaaggactcctgcaacggtgactctggggggcccctgatctgcaacgggtacttgcagggccttgtgtctttcggaaaagccccgtgtg

SEQ ID NO: 13837 - DNA, 731 bp, Homo sapiens
  misc_feature 1, 158, 590, 698: n = A,T,C or G
nacgacagtagggggagcggcaacatggcgtccaggtctaagcggcgtgccgtggaaagtggggttccgcagccgccggatcccccagtccagcgcgacgaggaagaggaaaaagaagtcgaaaatgaggatgaagacgatgatgacagtgacaaggnaaaaggatgaagaggacgaggtcattgacgaggaagtgaatattgaatttgaagcttattccctatcagataatgattatgacggaattaagaaattactgcagcagctttttctaaaggctcctgtgaacactgcagaactaacagatctcttaattcaacagaaccatattgggagtgtgattaagcaaacggatgtttcagaagacagcaatgatgatatggatgaagatgaggtttttggtttcataagccttttaaatttaactgaaagaaagggtacccagtgtgttgaacaaattcaagagttggttctacgcttctgtgagaagaactgtgaaaagagcatggttgaacagctggacaagtttttaaatgacaccaccaagcctgtgggccttctcctaagtgaaagattcattaatgtccctncacagatcgctctgcccatgtaccagcagcttcagaaagaactggcgggggcacacagaaccaataagcctgtgggaagtgctactttaccttctgattagtaagacntttggggaagcaggaaaaacattccaaaagaat

SEQ ID NO: 13838 - DNA, 825 bp, Homo sapiens
  misc_feature 13, 18, 19, 30, 43, 58, 59, 61, 62, 69, 458, 669, 731, 758,759, 760, 763, 791, 800, 808: n = A,T,C or G
ttttgaccatacnatccnncttgcttgttncttttggccgcancggcctacggcgcgnnannagacagnaggggtctgtgtcagtctataacttgcctcctctgggcctgttaaagcatgaagactgcatgacacaagagaaatgcaagccctacggttcctttctcagcagcgaattcacttgagaggatgctcttgactcattctctctgctctttcctgctcagatttctgataaaaatagagagcataggggaacagataatgaaataggaaacccactcgtgggttccacagatacctaccgaaggcctactgtgtgctagaattgtagctcaggagttctcagtgtagctgctcactgaagttaccatggcaggtttcaactggcagaatccaggctccgtcccgcccagagattctgatgaaattggtttagggtgtggctcgggcctcangaattcagaaagcttcccaggtgcttccaatgtgcagccagggttagggacctctaccctagacacaaagtattggacagatagacctggtgccagagatggccatgagctgtaagctaggacgtgccccacctgagctctgcactagctagttcaaacaggcgctttaaaggcagtgtgaaaggggacagcctgttctgccaggtctcanaatgtatattattaagtgccattaaaagggacctgaacaaaatgggtgtcttgtaggcttanggaggaaaataaaattacttggaaccnnnctntgtctgaagggaaataaaatgtttcatnccctggttntggttctntaaacaagggataaata

SEQ ID NO: 13839 - DNA, 268 bp, Homo sapiens
atagtttaaatctaaaaaattatgtgagaagaaccctttgttatttgaaggggatgtttgaagattttgtaaccgtgccttttaggtagtcctaaatttctaattgtagttaaaaacatgccattttcatttctaacattttaagtatatggtttagaagtggtaagtatagttctattttttttgcaataggttttagataatttttgtcttacaaaattaaaagtgaatactcattaattctgaaacaagttagttagcttgcttt

SEQ ID NO: 13840 - DNA, 360 bp, Homo sapiens
tttgaggttttttcactgcaccagtagtgagttcagactgaggccctgagtacagtagttcccctttatctgtggtttctctttccagagtaccagttgccattggtcagccacagtctgaaaatgttacattactactcatgccctttggggctatgattaagtaaaataagttacttgtacaaaaacagtgtgatactgtgacagtagatctgatcatcaagatggccactaagggactagccggcaggtagaatagatggacaaagggaatgattcgtatcctgtgttgcaggacagcgtgagatttcatcatgctactcagaacacatgcaatttaaaacttacaaactgcttttt

SEQ ID NO: 13841 - DNA, 485 bp, Homo sapiens; identical to SEQ ID NO: 10746

SEQ ID NO: 13842 - DNA, 308 bp, Homo sapiens
cctttctttctttctttctttctttctttctttctttctcccttcctttctccctttctttcccttcctttcctttcctttccttttttgggaaaacagggctctccaaaaaaaataataaataaaattattggcccctaaggaaacagggacctcttaaggtaaaaatccccttttaaaaatgtccatagcccctcccttcttcctttcttttccttcctttctttcttccttccttccttccttcctttcttcctccctcccttcctccctttctttcctcccttcctttctttcttttttttttt

SEQ ID NO: 13843 - DNA, 515 bp, Homo sapiens
agtggatcccccgggctgcaggttttttttatgggtgaaaagatatatatatatatatattcagaattaggcagctggactcagtttatatgatcccaattttgttggcaacatccaaagcatcgtaatcaggagccagtcgaacatatgccttcttctctccatcaggccgaatcagggtgttgaccttggccacatcaatgtcatacagcttcttcacagcctgtttaatctggtgcttgttggctttaacatccacaatgaacacaagtgtgttgttgtcttctatcttcttcatggcagactcagtggtcagcggaaacttgatgatagcatagtggtcaagcttgtttctcctgggagcgctcttccgaggatatttgggctgtctccggagtcgcagtgtcttcggccgccggaaggtgggtgacgtgcggatcttcttctttttgtggctgtggacacctttcaacactgccttcttggcctttaaagccttcgctttggcttcagct

SEQ ID NO: 13844 - DNA, 90 bp, Homo sapiens
gtgggggcgccgggccgtcacgatgagcgccctgggcagcccggaccggacctactactttctgctcaagttcctgctggagggcgacat

SEQ ID NO: 13845 - DNA, 649 bp, Homo sapiens
  misc_feature 53: n = A,T,C or G
acaagctacttgttctttttgcaggatcccatcgattcgtgttcctgtgccangaaagaaagttaaaatacttgcttaagaaagggaggggggtgggaggggtgtagggagagggaagggagggaaacagttttgtgggaaatattcatatatattttcttctccctttttccatttttaggccatgttttaaactcattttagtgcatgtatatgaagggctgggcagaaaatgaaaaagcaatacattccttgatgcatttgcatgaaggttgttcaactttgtttgaggtagttgtccgtttgagtcatgggcaaatgaaggactttggtcattttggacacttaagtaatgtttggtgtctgtttcttaggagtgactgggggagggaagattattttagctatttatttgtaatattttaaccctttatctgtttgtttttatacagtgtttcgttctaaatctatgaggtttagggttcaaaatgatggaaggccgaagagcaaggcttatatggtggtagggagcttatagcttgtgctaatactgtagcatcaagcccaagcaaattagtcagagcccgcctttagagttaaatataatagaaaaaccaaaatgatatttttattttaggagggtttaaat

SEQ ID NO: 13846 - DNA, 502 bp, Homo sapiens
gcggccggggttttttttttatttttttccccctataactgtttattagaatgggaatatattccaaatcaataactaaaaaaaaatcaaattacagagcatgcataaaatacaaagtagcaatttacaaatagataatattatcttcataactaatacactaaaataataaaatggctatagaagcaaacccaatatgactgactacagcaatgccttccgtgtgccccacacatcatgagcaccgcaagagacaaaagattaactatgaaatatagtaatctaagcaagcccacacatacatatttttggggatttcccaccatcctgaatagtatcactgcagttgacacaacttccaggaaactgcagagtaagtgcttaatattatccacgagaaagcaaaactaaatattagtgtgcacatttctgaatgagaaactaattgcttcattgatttcaacaatgtagtggaagaaaactatttcagatctctacaatg

SEQ ID NO: 13847 - DNA, 612 bp, Homo sapiens
  misc_feature 203: n = A,T,C or G
tatttagtgacactatagaaggtacgcctgcaggtaccggtccggaattcccgggtcgacccacgcgttcggcgattacaggcgtgagctactgcacccggcaaccctatgtttttttctaagaatatagtgtcccttgccccctgctacaagccttacccagtgttacataatttattgtaattaaattgtttattaatgtnacattcttgctgtagaagaaaacgtgtccttttgggctcagtacagtatatgtttcttaagtaagagggatcatattaaaccagctacttaatgtgaagcagatagccagtgttctccatgtacaatcttagggagggtaatttttgttttggctgtgtaattatggtttgaggcagcccattaatcgcatatttcagctgtcaaatagaaatttggcccagaaaggaatacactttggctttacaaaactgcttattttcaaatttttaaatggggacaaaaacgaatatgctatattatatacttttatttatataatttttttttcagcaactttttctcttttgaaaatgcaagagcctgaaaaacattgtgaatatacttgtaacattgcaaagctatttcacc

SEQ ID NO: 13848 - DNA, 609 bp, Homo sapiens
tttgtacaaaaaagcggctggtaccggtccggaattcccgggatatcgtcgacccacgcgtccgaggccctatgcctcaccctgagaacgcagtgagcatgaggtggacctgtttgctgggaaccccaggtcacccccttttcttcctactctgtgcctggagcatcatgtccacccctgcagatccttggaaaagaaaatgtttatgttgcagggtattgcatggtcacgagtgagggcaggcccctggggacacatctgcccacagctgcacaggccagggcgcaggcacatctgttggttctcaggcctcagataaaaccatctccgcatcatatggccagtgaccgctttctcccttcaagaaaattctgtggctgtgcagtactttgaagttttaattattaacctgctttaattaaagcagtttcctttcttataaagtggaatcaccaaatcttatcacacagagcacagtcctgtagttacccagcccgctccagcagtgcgggagattgtaaggaagcggtggcggctggtgaagcaagtctcacatgtcggcgttcttggccaatggatacaaagataaagaaaatgttgcctttttct

SEQ ID NO: 13849 - DNA, 429 bp, Homo sapiens
  misc_feature 24, 348, 376, 387, 393, 399, 410: n = A,T,C or G
aagcggaaaggggaggcatgggcntgaacgagaagcagatcctggagaaagtgaacaagtaggtttgtagtgagcttggcctacggctagtgagaccaaggaccgcgctgtcctggtgctgacactgatgaacgggggcgacctcaagttccacatctaccacatgggccaggctggcttccccgaagcgcgggccgtcttctacgccgccgagatctgctgtggcctggaggacctgcaccgggagcgcatcgtgtacagggacctgaagcccgagaacatcttgctggatgaccacggccacatccgcatctctgacctgggactagctgtgcatgtgcccgaggncagaccatcaaagggcgtgtgggcaccntgggttacatngctccngagttngtgaagaattnaacggtacacttcagccct

SEQ ID NO: 13850 - DNA, 465 bp, Homo sapiens
ccagacttggcacgaggggcagttcacggtcatccagctggtgggcatgttgcggggcattgctgccggcatgaagtacctgtccgagatgaactatgtgcaccgcgacctggctgctcgcaacatccttgtcaacagcaacctggtctgcaaagtctcagactttggcctctcccgcttcctggaggatgacccctccgatcctacctacaccagttccctgggcgggaagatccccatccgctggactgccccagaggccatagcctatcggaagttcacttctgctagtgatgtctggagctacggaattgtcatgtgggaggtcatgagctatggagagcgaccctactgggacatgagcaaccaggatgtcatcaatgccgtggagcaggattaccggctgccaccacccatggactgtcccacagcactgcaccagctcatgctggactgctgggtgcg

SEQ ID NO: 13851 - DNA, 616 bp, Homo sapiens
acagaagggatgttaaagaaagacatggcggagtgaatatgattccctgctgccagatgtgtatgaatggccagaatctgcatcaagccctcctgtgataacagaatagaagcactcccctgataaatactttctgtgctccagggaaccccttttttcagacaagaagagataatgtcttcagttttatggtgttttctgtgttttgttctccctgaccactttggttgatgtattttttccatgcgtctccacatctgttggggtagacgtgttgattgattgcattgcccaccagcaccctacaatcagatagttgtgatgctttaattctaacatacagcccgtaccacatccaggagatgtaaaaagtgtgtttgtgaatgtcttcacttgtactctaattcagacttgccaaagtatttgctatttactattatgggtaatactcttctctggcctagttcttacagagctactaaaatagaaatttacttttatggatagaagtacagaattttgagaagaaactaaattgtcaccaaattttaaggaaaaattgtcattatctaaaaatgttcttatatatctgcttcatcttaccttcatactctga

SEQ ID NO: 13852 - DNA, 754 bp, Homo sapiens
  misc_feature 546, 556, 661, 675, 677, 717, 747, 752: n = A,T,C or G
aaaaccgatggggaacctggcccccaaggctggtcccccagggaacgggcagcccttcaagaggagtttagtgacgtcctcatctacctggtggcattagcagcccgctgccgtgtggatctgccgctagcagtgctctccaaaatggacatcaaccggcgacgctacccagcccatctggcccgcagctcttcccgcaagtatacagaattgccccatggggccatctctgaagaccaggctgtggggcctgcggacattccctgtgactccacaggccagacctcaacctagaaagatggccacaggacttgcaactcagggtggtgtctgaagagcagagagtggcctggccctggagcctttttctagtcttttcagaatagatcatgggcctgaggcctccacttcttgaggtctgaggcccagcagcctctagaaggtagcctcctggtgtttgttctcccagtaaaatggttttgggcgataacttctagattattcctggatggccagggaggctctctgtctcagcaggtgatgacnggggtaccangggtgcctctgagaccattctcgtgtttccctgttgtaccttttgcctgcaggcagaagatctggttctagcaattccagtaggatgtatgtagttcttcccctntaaaatgaagctgnanatcaaatgtgagcagctgctggttaatgcacttgaccttnaactaatactactaatatcgtctgcttatntctgntt

SEQ ID NO: 13853 - DNA, 304 bp, Homo sapiens
tccaccgcggtggcggccgctctagaactagtggatcccccgggctgcaggaattcggcacgagctgttctaggtgcctgggatacagaagtgaaaataaattcttgccccatagagttaaatctgcaatcttagaatgttatcagatcatgttgtatgttcaaacttaaaatagattgatgggtaaataatttatttccttattagtgaggttgaacatttctccatatgtttgtttagtacatttctaaaataagctttgatagcctctaaaataaagaaaatagggagaccctttctttac

SEQ ID NO: 13854 - DNA, 389 bp, Homo sapiens
  misc_feature 64: n = A,T,C or G
cgagcagctccgccggacgactcgctctgttgtccatcccaagtaccaccagggctcaggcccnatcctgccaaggcgaacggatgagcacgatctcatgttgctaaagctggccaggcccgtagtgccggggccccgcgtccgggccctgcagcttccctaccgctgtgctcagcccggagaccagtgccaggttgctggctggggcaccacggccgcccggagagtgaagtacaacaagggcctgacctgctccagcatcactatcctgagccctaaagagtgtgaggtcttctaccctgggcgtggtcaccaacaacatgatattgtgctggactggaccggggccagggaccctttgccagagtgactcttggaggccccctggg

SEQ ID NO: 13855 - DNA, 605 bp, Homo sapiens
  misc_feature 529, 541: n = A,T,C or G
ttgtcgcagctgttttaattcaatcccacgcccctgtccagcaggaaaccccttatagaaaacccaaatcctcatcttggagtttctccttcagccagggcagcacttgaaagaggttgatgtgaaagtctcgggcgtgagcaggtacctgcttttgccgcttctggtttttgcagacatccactactccccagctgattacaccaacttgaatgaaacgacttctcttgtgaactatcaaggggccgccagaatcacctctgcaagtattggggtcagcatagggactcactcctccagtacaaaggaaccgaggggtgaccacctctgagatgtccttgactttgtcatagcctggggcatattgagcatctctctcacagctgcctttcttatccccattcttgatgtagacctccttccgagtcagctttttctcctcctcagacacaaacagagctttgatatcctgtgcagggagcagctctttccttttgttgctggcaagtggtagttggaggagcctcanagcctcgagtgnttccctggtgccaggggagacaatggccctgatagctgccatatttcagcttattcttggagct

SEQ ID NO: 13856 - DNA, 452 bp, Homo sapiens
  misc_feature 47, 49, 52: n = A,T,C or G
ttctcagcattttcaaagcactttattgagttcctgcgccatcctgngngangctggccgcactgggggaatgggacacaatcttgccttccatgccccagccactctctcactgcggaatcaccaaggagggaaagatgagtccctgagcaatcaggaaacggtgtgctcccggatccaggccaggtagtaggccacatcggtgtagacgcctggcttgttgcggtcaccacagcccgatccccagctgatgatgccttgcagggtgagccggcgctctgcaagcttggtcctcacacaccagcgggcctccggaatcaccctggcacgcatcggtgccgccctcgaggaaccctgcgcagagcatgccggggaggatggaggatccgtgcacgtccggggctgagcagcgctccagggagaggaacggtacctgcgccttccctcgtgcc

SEQ ID NO: 13857 - DNA, 487 bp, Homo sapiens
tccaccgcggtggcggccgctctagaactagtggatcccccgggctgcaggaattcggcacgagggaagggtacagtgattaatagcccaaattccagagttgaactgcctccatctggatccttactttactctgcatgtagtaggcaatcttaggtcaagaaagatttggaaacatgacgagggtctattaccgagaagctatgggtgcatttattgtcttcgatgtcaccaggccagccacatttgaagcagtggcaaagtggaaaaatgatttggactccaagttaagtctccctaatggcaaaccggtttcagtggttttgttggccaacaaatgtgaccaggggaaggatgtgctcatgaacaatggcctcaagatggaccacttctgcaaggagcacggtttcgtatgatggtttgaaacatcagcaaaggaaaatataaacattgatgaagcctccagatgcctggtgaaacacatact

SEQ ID NO: 13858 - DNA, 439 bp, Homo sapiens
  misc_feature 47, 48: n = A,T,C or G
ttgaagttacagatctgggacacgggcggtcaggagcggttccgcanntggtgtccacgttctacaagggctccgatggctgcatcctagcttttgatgtcaccgacctggagtcttttgaagccctggatatctggcggggtgatgtcctggccaagattgtccccatggagcagtcctaccccatggtgttgttggggaacaagatcgatctggcagaccggaagtaccagagcatcttagaaaatcacctcacagaatccatcaagctctcgccagaccagtcaaggagcagatgctgctgacctccagacgcctgctctggaagcccagaaacagagcctgccccgagcctggtcaccccaggcttgagaacaggtgaccatccccctccagccccactgcctgcccaagcacagtgcagggggcctaagctctg

SEQ ID NO: 13859 - DNA, 340 bp, Homo sapiens
  misc_feature 207: n = A,T,C or G
tccaccgcggtggcggccgctctagaactagtggatcccccgggctgcaggattcggcacgaggccggagcttcctacaatccatcctttgaagaccaccagaccctgctctcagcggcccacgaggtggagttgcagcggcagaaggaggcggagaagctggagcggcagctggccctgcccgccacggagcaggccgccacccangagtccacattccaggagctgtgcgaggggctgctggaggagtcggatggtgagggggagccaggccagggcgaggggccggaggctggggatgccgaggtctgtcccacgcccgcccgcctggccaccacag

SEQ ID NO: 13860 - DNA, 800 bp, Homo sapiens
  misc_feature 2, 3, 8, 12, 16, 24, 25, 26, 42, 44, 49, 59, 61, 88, 95,122, 123, 159, 238, 616, 751: n = A,T,C or G
cnncgctnagcnttgncttgtctnnnttggccgaagcggccntncggcntgcgagtacntngaccagaagggggattcggaggggaangctgacntccacaccaagtcgagacttccagggnntgtggccggggagcaagtcacatgctgtagctttcntgagccacaggcatcagtcaggcagatgtttgtcgactggaatggcgccaaatcttaaaggcagaccacgcaaaaaganaccatgcccacaaagaagagattcattcagtggtgttaaggattccaacaacaattccgatggcaaagccgtcgccaaggtgaaatgtgaggccaggtcagccttgaccaagccgaagaataaccataactgtaaaaaagtctcaaatgaagaaaaaccaaaggttgccattggtgaagagtgcagggcagatgaacaagccttcttggtggcactttataaatacatgaaagaaaggaaaacgccgatagaacgaataccctattttaggttttaaacagattaacctttggactatgtttcaagctgctcaaaaactgggaggatatgaaacaataacagcccgccgtcagtggaaacatatttatgatgaattangcggtaatcctgggagcaccagcgctgcacttgtacccgcagacattatgaaagattaatcctacctatgaaagatttattaaaggagaagaaataagcccctgcctccatcaacctcggaacaggaaacagttncaggaaatgagacaaacaaagttctggaccaaccctcaacatgaatacc

SEQ ID NO: 13861 - DNA, 164 bp, Homo sapiens
  misc_feature 3, 4, 10, 20, 36, 44, 54, 70, 74, 75, 84, 85, 88, 95, 114,129, 138, 143, 154, 156, 157: n = A,T,C or G
gcnnataacnacacacaggngcacctgtgagaaaangccacatnggtgtgcctntgagattacaacacanaggnncacttgtgnnaanacaacanaaagggctttctctttcanattaccaaatcttgngtttttttnatagngtactacatgngnnctctgtc

SEQ ID NO: 13862 - DNA, 453 bp, Homo sapiens
  misc_feature 301: n = A,T,C or G
cggcacgaggctaggttattttacaattttttcatggtcttgcatggacaggttgcatggacagcacttatttcttcttctattatataatttatttccttttgtatcaaaggaggaagaagccagacgacagtcaggagctcagtatggctcttttccagtggctttcctgggggaatgcctggtaattttcccggaggaatgcctggaatgggagggggcatgcctggaatggctggaatgcctggactcaatgaaattcttagtgatccagaggttcttgcagccatgcaggatccanaagttatggtggctttccaggatgtggctcaaaacccagcaaatatgtcaaaataccagagcaacccaaaggttatgaatctcatcagtaaattgtcagccaaatttggaggtcaagcgtaatgtccttctgataaataaagcccttgctga

SEQ ID NO: 13863 - DNA, 495 bp, Homo sapiens
cggcacgaggggtgtaggtaaatcgagtattgtgtggcggtttgtggaagacgttttgatccaaacatcaacccaacaataggggcatcttttatgaccaagactgtccagtaccaaaatgagctacataaattcctaatctgggatacagctggacaagaacgatttcgtgccttaacaccaatgtactatcgagggtcggctgcagctataatcgtttatgatatcacaaaagaagagacattttcaacattaaagaattgggtgaaagagcttcgacagcatggcccacctaatattgtagttgccattgcaggaaataaatgtgatcttatcgatgtaagagaagtcatggagagagatgcaaaggactacgccgactctattcatgcaatttttgtagagaccagcgcaaaaaacgcgataaacataaatgaactctttatagaaattagtcgaagaattccatccactgacgccaacctgccatctggc

SEQ ID NO: 13864 - DNA, 475 bp, Homo sapiens
  misc_feature 377, 385, 457, 463: n = A,T,C or G
agtacccctgctcagtatgcgctgatggagaaagacgccctccaggtggcccaggagatgaaggctgagtactgggcactctcatctctcactggtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgccagcaagaagaagcccacatgttgcccatgaggctggagggagactgttcagagactgcccagcccttagggaacttgtggccacccttcatttccttccagagcttgaacccctgggacattttgcactggactttnattccagnaccaaagagctggcctcttgggtgggcagttatttcccacagaggggttagctggggatcatgttagttcanttcctngcccccaggaac

SEQ ID NO: 13865 - DNA, 577 bp, Homo sapiens
caagctacttgttctttttgcaggatcccatcgattcgtgagggtaggaccctcccagccaggtgccggatataatctcgtggtgcgccgtttttttaagccggtccgaaaagcgcaatattcgggtgggagtgacctgattttccaggtgcgtccgtcacccctttctttgactcggaaagggaactccctgaccccttgtgcttcccaagtgaggcaatgcctcgccctgcttcggctcgcgcacggtgcgcgcacccactggcctgcgcccactgtctggcactcgctagtgagatgaacccggtacctcagatggaaatgcagaaatcacccgtcttctgtgtcgctcacgctgggagctgtagaccggagctgttcctattcggacatcttggctcctccccaagagttctggagtctgagaagtcaaggatcggggtgctggcctattcagttcctggtaagggctgtcttcctggcttgcagttgaactacttcttgctgtgtcttcacaagcatgcccccatcctgtgccgataagaactccagaccccaaactcagctcatacacaca

SEQ ID NO: 13866 - DNA, 212 bp, Homo sapiens
aaacacgatgggtgcatcacaaataggtgtaaacagtacacttttgtaatgtgtagacaccagtttctgcaacccccatgccacgcaaagtttcagggaaagtctttgaaagtacaatccggaaaactcagcaattcttaaaaaaaaatggctttccgctgttataagcctccttcctaaaactcagggtccgcagcagaataccctgaccc

SEQ ID NO: 13867 - DNA, 554 bp, Homo sapiens
tacgcctgcaggtaccggtccggaattcccgggtcgacccacgcgtacgggctcaatgaaggtaacaaaggagttaatttatccaaaagatggaagatgttacatgctaaaggaaaaaacataacccactacattagggctttacataatattatgagaatgtgctgaagacacttaaagcctgcactcccttgcaagctgagcaatgacaacattgtccaaatcttccaacagcaacaccccagtaagccaacagctacaagtggaacaagacagagatttctgagccctctattgaactaactgccatctccaggttaggtttgcagatttctatatttaaaaagtagaaagcatcagcagttgggggttgaattcttggtgtgtgtgcagttgcgtaaaaggactatttttatttctcgctgccgtatgaagaagctttgatcttggacgacttgctcaagggcccatgataatatattgatcacttctgactgttttcacccagactcgtttccataagctcagtctgtcaacaagaaatacttcatata

SEQ ID NO: 13868 - DNA, 431 bp, Homo sapiens
tatgacgtcgcatgcacgcgtacgtaagcttggatcctctagagcggccgcctactactactagcctactactactaaattcgcggccgcgtcgaccaaggaactggatggcgcgaccatctgcatccaggccggtaccaccaccgagctgaatgtgtccgactacttccgcgccaatggcctgaagtacaccccgatcaccttcgacacctccgacgaaagcgccaagtcgctggaatccggtcgttgcgacgtactgacctcggacaaatcccagctgttcgcccagcgcagcaagctggcctcgccgaaggactacgtggttctgcctgaaaccatctccaaggagcctctgggcccagtggtgcgtaacggcgacgaagagtggaccaagatcgttcgttgggtcggctatgcgctgctcaacaccg

SEQ ID NO: 13869 - DNA, 687 bp, Homo sapiens
  misc_feature 587: n = A,T,C or G
gaaaaaacaataaacacctttattacataggtgaagacaaaacaaggatttatttgcctttgcgggccttgatattcctaagatagaactccaactctttgccctctagcacatagccatctgctcggccacactgtcccggccttgaagcgatgcacgcaagaagcttgccctgctggaactgctcctccaggagactgctgattttggcattctttttcctttcatcatatttcttctgaatttttttagatcgttttttgtttaaaatctcttcttcctcaggagtcagcttggctcccttcttgcggcccaggggcagcgcatagtgggactcgtatcactgtcggtacggtgtgctgtcgatgagcacgatgcaattcttcaccatggtcttggtacgaagcatctcgttattagatgcattgtagacaacatcgaggatccttgttttacgagtacaacatgctgatgcccagtgagaaattcgccacgtgccagctcaggccacggtatttcttgttatctcctcgcacacgaactgtgtgtgatggcggcgggagcaattcttggtgttgggcactggnggtcccaaactcatacttgcggcctctggtggttagggcttacgcttgcccccgtgtttagggcgctgttgcatgttgtcccgagagatgcccatcgctc

SEQ ID NO: 13870 - DNA, 700 bp, Homo sapiens
  misc_feature 551, 578, 602, 611, 627, 641, 643, 647, 648, 655, 658, 678,691, 692, 693, 694, 695, 696: n = A,T,C or G
cagcatcggcatcaaccaccacctggctagaaacacaggccccactcccaaacgagttgaatcaggatctgcatttgaataaaatcccaacatgctttataccagacaggagttgacagtagtctaatagtagatgtagggatgtgtatgtatgaataagaaatggagttgctccactttcctcatgtttcctcttttatttcccttgcctactagaagattacatttgggagaagccacttcccctctctggatctctgtttcactacctatgaggagattaaactagactgtctataagagtccttctctgagttgttctctgatcttggattctaaaggctggcacttgtatgaaaccagctgtcctgctttctggaaaaagtccagcgccattgttaagcaggaaaatttctcctgtgtggttctgccaaaacaaaagctcagactattattcagatctggctggcaagagagatttgtcaactacatgtttattgaatgatgaaacagctgcacacattcctgcacagaaaacacacattgtctangtgacaaagagtaatgtggacactcanggccatcttctgacccttgctagnttttttggnagttggttggtttggntctttggatttttngntggnntggggcnggnttgaaaaggggctattttgncctccggtggagnnnnnnctga

SEQ ID NO: 13871 - DNA, 579 bp, Homo sapiens
  misc_feature 24, 29, 58, 69, 98, 134, 144, 180, 185, 188, 192, 194, 201,243, 253, 270, 290, 310, 317, 333, 372, 394, 399, 409, 421,450, 454, 463, 470, 481, 494, 497, 509, 511, 537, 548, 555,564, 567, 568, 571, 572, 576: n = A,T,C or G
aggattttattctttttttttttngaaanggagcctcactcttgcccaggctggaagngcaggggtgcnatcttggctcactgcaacctctgcctccngggttcaagcagttctcctgcctcagcctcccaagnagctgggatnacaggcgtccgccaccatgcccagccaatttttgtnctttnagnaaananggggttncaccatgttggccaggctggtcttgaactcctgacctcaggngatccactcncctcggcctcccaaagngctgggattataggcatgcnccaccatgcccggccggctnatgattnaaaacatgaattgttnatttctggaattttccacataatatttttggaccaaggntgcctcaggtaacaaactacanaaagngaaattgcanataaaggggatnactgctcctctgctctaaaattggggttngggngatcaaaancaggtanccaatgggaanagcacttctgagnganaactaaagcagntngggggccttttcacattctccaatgncaaaatatttnccacttncattttctnttnnccnnattngcc

SEQ ID NO: 13872 - DNA, 190 bp, Homo sapiens
tccaccgcggtggcggccgctctagaactagtggatcccccgggctgcaggaattcggcacgaggggagacaaattggactcgttcattaaaccacctgagtgcagtagtgatgtcaaccttgagctccggcagcggaacagaggggacctgacagcggactcggtccaaaggggttcccgccatggcct

SEQ ID NO: 13873 - DNA, 504 bp, Homo sapiens
tccaccgcggtggcggccgctctagactagtggatcccccgggctgcaggaattcggcacgagcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgaaaactaatgcaaggctggccggaagcccttgcctgaaagcaagatttcagcctggaagaaggcaaagtggacgggagtggacaggagtggatgcgataagatgtggtttgaagctgatgggtgccagccctgcattgctgagtcaatcaataaagagctttcttttgaccc

SEQ ID NO: 13874 - DNA, 572 bp, Homo sapiens
taggcctatttaggtgacactatagaacaagtttgtacaaaaaagcggctggtaccggtccggaattcccgggatatcgtcgacccacgcgtccgtgttctttgaagctgatggccctaaacagatgaagtgctccttccaggacctggacctctgccctctggatggcggcatccagctacgaatctccgaccaccactacagcaagggcttcaggcaggccgcgtcagttgttgtggccatggacaagctgaggaagatgctggttccctgcccacagaccttccaggagaatgacctgagcaccttctttcccttcatctttgaagaagaacctatcttctttgacacatgggataacgaggcttatgtgcacgatgcacctgtacgatcactgaactgcacgctccgggactcacagcaaaaaagcttggtgatgtctggtccatatgaactgaaagctctccacctccagggacaggatatggagcaacaagtggtgttctccatgtcctttgtacaaggagaagaaagtaatgacaaaatacctgtggccttgggcctcaaggaaa

SEQ ID NO: 13875 - DNA, 771 bp, Homo sapiens
  misc_feature 251, 533, 544, 558, 576, 629, 638, 677: n = A,T,C or G
gcatttttagtagagacgggtttcaccgtgttagccaggatggtctcgatctcctgacctcgtgatccacccgcctcagcctcccaaagtgctgggattacaggcgtgagccaccgcgcctggcctgctcttttaaataaacatttgccttgcaactttctattttgtttaaaatgctaccattttttcgtaagataagagatatgtttcaacctaatttccaaattactttgtgaattccatgaagattntctatacttgatacttaggaggttaaaaaatgcttttaaagtctcattaagtcttaagtaaatggaaattatagaataattttcctagatttcaatgtcaattctattttcttctgttatttctaagcagactgacatgattgattcttaaaagaaaacctgatttgagcaatctattgagcaaaacatttgtaaataaatagtgcccaattaaatcagacttattttaaaaaatatatgtcctgtactgcattgttttcattaagttataaccacaagaanatagtacccanatgttcaaacttcnttagctgacagggccttnttgtgtgaaacatatttattacacatacatcacactctatgcatgatctactntgctcttgnaggcaggtctctgtcttatccactctgacactcagcacnctattgagtgccacagcgccatatgggtgcttcatatcagaactgacattttcagacactactagatggttacacccagtggatggccatcaga

SEQ ID NO: 13876 - DNA, 688 bp, Homo sapiens
  misc_feature 410, 553: n = A,T,C or G
gctgacacccggcactttattagtggggaaactcgccttggtctggcagagactgggatcaacaggaccagcacccatctcgaggtggtattttctgtaagatcaggtgttcctccctcgtaggtttagaggaaacaccctcatagatgaaaacccccccgagacagcagcactgcaactgccaagcagccggggtaggaggggcgccctaggcacagctgggcccttgagacagcagggcttcgatgtcaggctcgatgtcaatggtctggaagcggcggctgtacctgcgtaggggcacaccgtcagggcccaccaggaacttctcaaagttccaggcaacatcgttgcgacacaccggagaccaggtgatgagcttggggtcggtcataagcgcggtggcgtcgtcnctgggagctggcagggcctcccgcaggaaggcgaagagagggtgcgcccccgcaccgttcacctcgcacttttcgaagagcatgaagttgggctcgaacccaccaccaggcccgacgtacttgaaggaattcagaatctcttngttctttgcgttctcctgatgcccaaactggttgcacgggaagccgagcaccacccagccccccgggtccgaaggcgccgctgaaactcgttcattatgggtgtagtcccgggacccggggtgcctaaaagggac

SEQ ID NO: 13877 - DNA, 76 bp, Homo sapiens
aagttttttttaccaccatatttttctactctgtaaggaagtatatctttatggggaaaagagaatttggggtgtt

SEQ ID NO: 13878 - DNA, 467 bp, Homo sapiens
  misc_feature 369, 377, 405, 412, 465: n = A,T,C or G
actcaggcgtgggcaagtcatgcctgctcctgcggtttgctgatgacacgtacacagagagctacatcagcaccatcggggtggacttcaagatccgaaccatcgagctggatggcaaaactatcaaacttcagatctgggacacagcgggccaggaacggttccggaccatcacttccagctactaccggggggctcatggcatcatcgtggtgtatgacgtcactgaccagggaatcctacgccaacgtgaagcagtggctgcaggagattgaccgctatgccagcgagaacgtcaataagctcctgggtggggcaacaaggagcgaccttcaccaccaaggaaggtggttgggacaacaccacagnccaagggntttttgcagattcttttggggcttcccnttttttnggaggacgaggcgccaagatttgccaccattttttcgaggcaggcttttcttnga

SEQ ID NO: 13879 - DNA, 630 bp, Homo sapiens
tcctgtggctcctgctgggccttcggggctgtggaagccatctctgaccggatctgcatccacaccaatgcgcacgtcagcgtggaggtgtcggcggaggacctgctcacatgctgtggcagcatgtgtggggacggctgtaatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagtgtaccaacacgtcaccggagagatgatgggtggccatgccatccgcatcctgggctggggagtggagaatggcacaccctactggctggttgccaactcctggaacactgactggggtgacaatggcttctttaaaatactc

SEQ ID NO: 13880 - DNA, 534 bp, Homo sapiens
tccaccgcggtggcggccgctctagaactagtggatcccccgggctgcaggaattcggcacgaggagacttggggccagcgcttctggtctggtaaatatgtatgatgtgttgtgctttttttaaccaaggaggggccagtggattcccacagcacaaccggtcccttccatgccctgggatgcctcaccacacccaggtctcttcctttgctctgaggtcccttcaaggcctccccaatccaggccaaagccccatgtgccttgtccaggaactgcctgggccatgcgaggggccagcagagggcgccaccaccacctgacggctggggacccacccagcccctctcccctctctgctccagactcacttgccattgccaggagatggccccaacaagcaccccgcttttgcagcagaggagctgagttggcagaccgggcccccctgaaccgcaccccatcccaccagccccggccttgctttgtctggcctcacgtgtctcagattttctaagaaccaaaaaaaaaaaggg

SEQ ID NO: 13881 - DNA, 512 bp, Homo sapiens
gtctggctcacctggaggaagaggtccacgacaaggtggttgcccgggacctggttggagccatgttgagcccactgccgcagccacgcccctctgccccccaggtgctggcccaccccttcttttggagcagagccaagcaactccagttcttccaggacgtcagtgactggctggagaaggagtccgagcaggagcccctggtgagggcactggaggcgggaggctgcgcagtggtccgggacaactggcacgagcacatctccatgccgctgcagacagatctgagaaagttccggtcctataaggggacatcagtgcgagacctgctccgtgctgtgaggaacaagaagcaccactacagggagctcccagttgaggtgcgacaggcactcggccaagtccctgatggcttcgtccagtacttcacaaaccgcttcccacggctgctcctccacacgcaccgagccatgaggagctgcgcctctgagagcctcttcctgccctactac

SEQ ID NO: 13882 - DNA, 773 bp, Homo sapiens
  misc_feature 1, 9, 616, 709, 724, 727, 735, 739, 744, 749, 755, 763: n = A,T,C or G
nacgacagnagggtatatttgtatatttacagttacaaaacaaatgtacttttaccttttatttctgaccctgtgtgttagagcagttgcatgctctcctgctgttaaaaacacattgttaagctgtggatttgtactcaataatgacttaggataaacatttattttcattcattgctttacatactagacatttttcttctctttgtaagtagattcaaattagatagtcaataaaacatcttgaaaatcccacaagccaattatgtctctctagtctgaatggcttcattgtttctttctcagtattagaaattatagttacaatgaattgcatatgaagaaggcagacatttatttttaatagccaagtagttctgcaaatagttcttttaacaatttgacctctctccaaaacagagacacatataagtagtgctcatccatgcactactaataatacatggcttattccaaagtttttagtcaacttttgggacttggggtgcattttctcacagaaagaatagtagttaggttccctaacactaccgctgatagctcacctgggaactgaatccacctaaccatgaatgtccttcacttgtaacgtggntcacagggtactaatcatagatcctgaccagcatttgtacactgctctactaggacacagcatgcagcagcacactccaccctgggagtctgngacctctgtcctagngtngaatgganaaanatcanccagngggagngcagagcncatttgaact

SEQ ID NO: 13883 - DNA, 475 bp, Homo sapiens
ctcctttccattgtcggatgagaatgatgtttttgacaagctaagtgtcattgcagaagactctgagagcggcaagcagaatcctggtgacagctgcagcctcgggaccccgcctgggcaggggccccaaagctaggctcttagaaggaaacacactcggctgggcacagtgacgtactccatctcacatctgcctcagtgagggatcagggcagcaaacgagggccaagaacatctgagccagccccacatctagaactcccagaccctggacttagccaccagagagctacattttaaaggctgtcttggcaaaaatactccatttgggaactcactgccttataaaggctttcatgatgttttcagaagttggccactgagagtgtaattttcagccttttatatcactaaaataagatcatgttttaattgtgagaaacagggccgagcacagtggctcacgcctgtaata

SEQ ID NO: 13884 - DNA, 568 bp, Homo sapiens
atctttctcttgccgcgtgctggtgttggaggaccctccctgcttcagatttaccaacagcatgaatcaagaaaagttagccaaacttcaggctcaggtccggatagggggcaagggtacagctcgcagaaagaagaaggtggtacatagaacagccacagctgatgacaaaaagcttcagagttctctaaaaaaactggctgtgaataatatagctggtattgaagaggtgaacatgattaaagatgatgggacagttattcatttcaacaatcccaaagtccaagcttccctttctgctaatacctttgcaattactggtcatgcagaagccaaaccaatcacagaaatgcttcctggaatattaagtcagcttggtgctgacagtttaacaagccttaggaagttagctgaacagttcccacggcaagtcttggacagtaaagcaccaaaaccagaagacattgatgaggaagatgatgatgttccagatcttgtagaaaattttgatgaggcatcaaagaatgaagctaactaaaagtttggtttttggaagctggcatggact

SEQ ID NO: 13885 - DNA, 499 bp, Homo sapiens
tccaccgcggtggcggccgctctagaactagtggatcccccgggctgcaggaattcggcacgagccccaacaggcatcaccccgctaaatcccctagaagtcccactcctaaacacatccgtattactcgcatcaggagtatcaatcacctgagctcaccatagtctaatagaaaacaaccgaaaccaaataattcaagcactgcttattacaattttactgggtctctattttaccctcctacaagcctcagagtacttcgagtctcccttcaccatttccgacggcatctacggctcaacattttttgtagccacaggcttccacggacttcacgtcattattggctcaactttcctcactatctgcttcatccgccaactaatatttcactttacatccaaacatcactttggcttcgaagccgccgcctgatactggcattttgtagatgtggtttgactatttctgtatgtctccatctattgatgagggtctt

SEQ ID NO: 13886 - DNA, 393 bp, Homo sapiens
tccaccgcggtggcggccgctctagaactagtggatcccccgggctgcaggaattcggcacgagctggactaggtctaccttgatcttgaagattcccttggaatgttgagatttaggcttatttgagcactacctgcccaactgtcagtgccagtgcatagcccttcttttgtctcccttatgaagactgccctgcagggctgaaatgtggcaggagctcccagggaaaaaggaagtgcatttgattggtgtgtattggccaagttttgcttgttgtgtgcttgaaagaaaatatctctgaccaacttctgtattcgtggaccaaactgaagctatatttttcacagaagaagaagcagtgacggggacacaaattctgttgcctggtggaa

SEQ ID NO: 13887 - DNA, 673 bp, Homo sapiens
atcggctgctgggcagtgccaatgtggtgaccgaggctctgcagcgctttacccgggcagctgctgactttgccacccatggcaagctcgggaaactagagtttgcccaggatgcccatgggcagcctgatgtctctgcctttgacttcacgagcatgatgcgggcagagagttctgctcgtgtgcaagagaagcatggcgcccgctgctgctgggactggtgggggactgcctggtggagcccttctggcccctgggactggagtggcacggggcttcctggcagcctttgatgcagcctggatggtgaagcggtgggcagagggcgctgagtccctagaggtgttggctgagcgtgagagcctgtaccagcttctgtcacagacatccccagaaaacatgcatcgcaatgtggcccagtatgcgtggacccagccacccgctaccccaacctgaacctccgggcagtgacccccaatcaggtacgagacctgtatgatgtgctagccaaggagcctgtgcagaggaacaacgacaagacagatacagggatgccagcaccgggtcggcaggcacccaggacgagctgctacgctggtgctaggagcagacagctgggtacccgggagtccacgtctccgatttgtcttcctcctgggctgatgggctagct

SEQ ID NO: 13888 - DNA, 592 bp, Homo sapiens
tcggcacgagttttttaactactgtgataatcaactttgatcctaacaatttaagaaatttgtataggaggataagaagaaccctaatctatagggaatgctcatgtccctgaaggaggacaggtcagtaagggcccaaattctctcctggtctttaggtggaaaggcaaaacatcacactttaaaaagaggctgctctcagccaaagcaagaaagacctctttcattaagcctattgatctgaagctattccaggaaggacaaaaaaagttcaagccagatgttcagcagcagccagagttggaccctatgtcacgagagttccgctgggaggcactgggtcccactgatgttgaaattgactgttggggcccaatcttgatgccatttgcctcattgtggacatcaaataaaccctgctggatcttcctatatatttctttggctgtgttaatgaaggcctcttcaacattgcaggctgttttggctgaagtttccatgaatataagtccatgctccctagcaaaggcctctccttcttctctcttcacatccctgcgggactctaggtcactgtaatcccagctactcg

SEQ ID NO: 13889 - DNA, 436 bp, Homo sapiens
ttttgtctcaagttcttttattcatataaataaagtttaaaggaatgggggagattaacatttcctgttttatgtttgtgaaattgtttgacacaaccttgacagtatcctttaatggcatgaggttaattgtactgttaaccaactttctatgttctggaactagtattatagtgaaaacatttacagtaagttgatgtttacaacctataagcaggtgaaatctgtgtatgtgacctgtttataagttgtattagcttagctcttgtgaacagtgtggaaaagtaagccatgaggagagcgatttaaccacctttaaaggacctaagatgtgctttttaagcacagtgtggatcacagaaactcactaagacaggacttcagcagccttttgtgtttggacaagtcagcataaataaagaatgacaaggcagca

SEQ ID NO: 13890 - DNA, 704 bp, Homo sapiens
  misc_feature 1, 563, 678, 686, 690: n = A,T,C or G
nggcaacgttgctggtgacagcaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaangaaaggagaatgttttgtggaccactttggttttcttttttgcgtgtggcagttttaagttattagttttaaaatcagtactttttatggaaacacttgaccaaaatttgtccanaatttganaccnttaaaaaggtaatg

SEQ ID NO: 13891 - DNA, 591 bp, Homo sapiens
caagctacttgttctttttgcaggatcccatcgattcgaattcggcacgagatgggaccaaatttaagcaatttttgtttttggctgaagagacaccaaaatattagaggacaaatatttttagatccatttaaggagttttgaagtgcctaagatgacctatttgtcagtggtgcaaaattaattctcttcttttttgagttgtagtgaatatgcaatttctgtgttccccttccaccctttaaatcttaggatgacaagttataaagaaagaagatctttgtctgggacccccaaagggatcctttctctaaggtctctgacagtgggtccaggaccagacctctctacaaaaaattgccccaactacagtttgcaaccccaaaccacattagaagtctgtgcagacatccctccgtggtgtgtgtcttggtgcattggaaaaggagtcaggagccactgtgaggtgagaatgaaagtggatctcagctgggcacggtggctcacgcctgtaatcctagcaccttgggggtcaaggtgggtggatcacttgaggtcaggagtttgaggccagcctggccaacatggcga

SEQ ID NO: 13892 - DNA, 704 bp, Homo sapiens
  misc_feature 475, 554, 599, 609, 615, 622, 630, 636, 652, 654, 655, 671,675, 686, 694: n = A,T,C or G
cgttcccccgctacatagtctttcttttgtgttatttagtttaccatttcttttttccatcttgttataacctccacgagttgtgtctcttttgttttctacattatacccaacggctagcacataacaggcacccaatatatactgaacgaactaaggaatgaatgaaggaatgaatgaataggtggcttataggaaacccctggggccagggactctgcaacatcaccatgtaactttttctttgtgctgagaagcagagagaaacaatagaagatatctcttaatctctcaaggatgctactcccaggactgcttgcaatttccgaggagataagccacaagttacagaaaggaagcagctgtgtagggcctgcaagtttcctgctgcaagtcaccctatgttcagaagttaccctggctgggccaggcatggtggctcacgcctgtaatcccacactctggggaggctgangcaagtggattgcttgagtccaggagttttgagaccagcctgggcaacatggagaaaccccatctatcaaaaaaattanctgggtgtggtggcatgaagcctgtaatacccagcttccttgggnaaggcttaangtgggnagaaatnaccctganccccangggggtcaaaggctgntnnttaagccaagatcacngccnactggaccttnaagccctngggcaaaccc

SEQ ID NO: 13893 - DNA, 488 bp, Homo sapiens
  misc_feature 259, 311, 338, 402, 412, 420, 422, 425, 441, 454, 455, 456,459, 464, 466, 468, 480, 482, 483: n = A,T,C or G
gggatttaatacctctgtaaaatgaagcagttacttccattttcctgaggtgagataagtgccctgcacaatgttataggcccagtaagtgagactggagctctgatctaatccctttcacattaaagtttgtgcagtaaaccagctatgtcagtttgccacatttgtaatagtgttcaataaattttcacttaaaggtttaatattaaagtagtagcaagaattcataaccttaattggctttaacagcttttctttncctgaaaacagatgcatatgtacacatgcacacagattgcttacaatatcancacgtaaaaggcctttgcccattgaantcggcactgctttggtgccttttttggtttttggctcggggttttgactgcaatcttttggatnaaattttttnttaaaaananctnacccttgggttttttnggcccaaaaaaannnttnactancngnctttttttttgngnnttttt

SEQ ID NO: 13894 - DNA, 51 bp, Homo sapiens
aaaaatttccttcttaagtttgggaaatttttaaaaaaaaactttttccaa

SEQ ID NO: 13895 - DNA, 428 bp, Homo sapiens
tttgtacaaaaaacaggctggtaccggtccggaattcccgggatatcgtcgacccacgcgtccggtccaatattaaaataattttaaaatccagttccttattggcaaggtacttcctgacttcagggacaaagcatcagtggaaccaattcagaaaaaaggatttccattgtccaggccttctagttgtacaaccaaaagacaggcagctggtgctgatcttttcccttcaaggattgggggtgggggttagcagctttatagataagggcagttctgatcataaaccccactacgttttcatgaaacagtagagttagcctgtctctttttgttttcaatcctgctgcttgcttctcttcctactaaatgtcctttgtggtgtttttctaaaataggatactttcatctgcattaaaaacctgttc

SEQ ID NO: 13896 - DNA, 78 bp, Homo sapiens
tggtacgcctgcaggtaccggtccggaattcccgggtcgacatcatcatcatgatcgctcgacatcgatacgactttt

SEQ ID NO: 13897 - DNA, 533 bp, Homo sapiens
aaaagacagtcattcataatgataatgaagaacttatcaaggttgaagggaccaaaattgtcttggggaaacagctaattgagagtgcggatgaggttcgcagaaaatctctggttctcaagtttcctaaacagcagcttcctccaaagaagaaacggcgagttggaaccactgttcactgtgactatttgaatagacctcataagtccatccaccggcgccgcacagaccctatggtgacgctgtcgtccatcttggagtctatcatcaatgacatgagagatcttccaaatacataccctttccacactccagtcaatgcaaaggttgtaaaggactactacaaaatcatcactcggccaatggacctacaaacactccgcgaaaacgtgcgtaaacgcctctacccatctcgggaagagttcagagagcatctggagctaattgtgaaaaatagtgcaacctacaatgggccaaaacactcattgactcagatctctcaatccatgctggatctctgtgatgaaaaactc

SEQ ID NO: 13898 - DNA, 477 bp, Homo sapiens
agttttgtttctttattatttaaaaaatattaacagcaattaaaaacaacaacaacaacaaaaaaaacattcacaacctgtcacagagtcctataagctttggccatttattcccaacggagtctttcatccaaaggcaggtggggaatttcagccaaaaggccccttcatggttttcatgggtgggtactgctgctccatcggcatggccccaaagcagtcagagggattacagtggccagccttgcctggctggcccatgggacccgggggcccagggatgccagggatgccttgctggcccattggtcctgttgcacccatcttgccatagcctggaggaccttgaggacctggggggccgggaagaccattttctcctgcaatgccaataccaatgtcccctttttcacctttggtaccaggcaatcctcttactcctggcaagccctgccgtccttctctgccaatctgacc

SEQ ID NO: 13899 - DNA, 407 bp, Homo sapiens
tcggcacgagggtgaagaacagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttcaaatgt

SEQ ID NO: 13900 - DNA, 485 bp, Homo sapiens
tcggcacgaggaggccatcggctttgtcaaggatgtagccaacatcacaatctatgacgaggaagcgatggtggaggctgtggccctctacaaccctgtgagctttgcctttgaggtgactcaggacttcatgatgtatagaacgggcatctactccagtacttcctgccataaaactccagataaagtaaaccatgcagtactggctgttgggtatggagaaaaaaatgggatcccttactggatcgtgaaaaactcttggggtccccagtggggaatgaacgggtacttcctcatcgagcgcggaaagaacatgtgtggcctggctgcctgcgcctcctaccccatccctctggtgtgagccgtggcagccgcagcgcagactggcggagaaggagaggaacgggcagcctgggcctgggtggaaatcctgccctggaggaagttgtggggagatccactgggacccccacattctgccctca

SEQ ID NO: 13901 - DNA, 569 bp, Homo sapiens
  misc_feature 447, 455, 490, 507, 519, 533, 565: n = A,T,C or G
gctacaaaatgcatttatttccagtcagacaaaattcttgaactgtatattcgggtacatattataaggtcatctttgatatatgccctgtttacaagatccatttctaattattaaagtgaatatcaaacacacatctttgcatcttaaaacataaataaactgctaatgtttataagccacaaatctggtcactgacatgagtggcctgcaattcttcagtgatgagcacacggcgatacagacaagatcagattacccaggtaggcaggcagcaggcacctgtaattcacccgctgactgtgctgttgtggcagtgacccttcttgtgaaaaaagagttatgtgcagacaaaagtgtgacatatgcaacgtggagaggcatttcacagaatgcaaacaccattcaggtaaaatttagtagactccagaatgaatgaaagcttcntgaatgcnaacctgttggtttacaatactggggcattgtggcncctttcactgggacagnttaataaattcnatttaagaaagtangggtaggggagaagctgaaccatcctttttgntgct

SEQ ID NO: 13902 - DNA, 412 bp, Homo sapiens
agtggatcccccgggctgcaggaattcggcacgagcagaggtggaattggggcccggcattccctcctcgtcccgggctggcccttgcccccaccctgcaactcctggttgagatgggctcatccaagagcgtcccagtcacaccagcgcggtctccgccgcacaacaagcatctggctcgagtggcggacccccgttcacctagtgctggcatcctgcgcactcccatccaagaggagagctctccacagccatgcctaccagcaggggagcaactggagggtcttaaacatgcccaggactcagatccccgctctcctactcttggtattgcacggacacctatgaagaccatcagtggagaccccccaagcccactggtgaaacagctgagtgaagtatttgaaactga

SEQ ID NO: 13903 - DNA, 589 bp, Homo sapiens
  misc_feature 488: n = A,T,C or G
tccaccgcggtggcggccgctctagaactagtggatcccccgggctgcaggaattcggcacgagtgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggaggaaatcagtacgctgaggggccaagtgggaggccaggtcagtgtggaggtggattccgctccgggcaccgatctcgccaagatcctgagtgacatgcgaagccaatatgaggtcatggccgagcagaaccggaaggatgctgaagcctggttcaccagccggactgaagaattgaaccgggaggtcgctggccacacggagcagctccagatgagcaggtccgaggttactgacctgcggcgcacccttcanggtcttgagattgagctgcagtcacagctgagcatgaaagctgccttggaagacacactggcagaaacggaggcgcgctttggagcccagctggcgcatat

SEQ ID NO: 13904 - DNA, 500 bp, Homo sapiens
ttttcttctaaactacttcgacaagacaaaagaacagtgtatgtttacttggaaaagttcatgacctttcagatgtcactccgaagagaggatgtgtggcttccactgatgtcttaccgaaattctttgctagctggtggtgatgatgacaccatgtcagtcattagtggaatcagcagccgggggtcaacagtacggagtaaaaaatcaaaaccatctacaggaaaacggaaagtggttgagggcatgcagctttcactcactgaagaaagtagtagtagtgacagtatgtggttaagcagagaacaaacactgcacacccctgttatgatgcagacaccgcaactcacctccactattatgagagagcccaaaagattacggcctgaggatagcttcatgagtgtttatccaatgcagactgaacatcatcaaacacctcttgattataatcggcgtggcacaagcctaatggaagatgatgaagagccaattgtgga

SEQ ID NO: 13905 - DNA, 537 bp, Homo sapiens
  misc_feature 395, 415, 429, 460, 464, 500, 512, 532: n = A,T,C or G
gggctatatattacataatgtgttaatgaaatgactagaaaaccttgagaacaaacaagaaacaaaggaaatttcagaatttctttctttcataatccacataaccactcctcctactctctctagtagaccttctggacatttaaatagtcaaaacgtggtcacttttggtggtgagtcatgtgggaaactgactgggagagaatatattcgggttttctggagttaaggaaatgctctacatcaaaagcggtgtgaggtcatctgctttgcaatttgtgtaaaaattttacagttaagattagcttatttcaatgtatgtaaattttccctcaaaaatcacaactgtaggccgggcgtggtggctcacgcctgtatcccagcactttggggangcccaggtgggaggatcacnaggtcaggatatcnagaccatcctggctaacatgctgaaaccccntctntctaaaatccaaaaattagctggcctggtggcgggntcctgtatcccnctactcaggaggctgaggcnaagat

SEQ ID NO: 13906 - DNA, 441 bp, Homo sapiens
ggaaacaaaggatattttattccttttttctgttgttgttgaggatagatcacgatacagagaacagcaatgggtcacagcgcacggtttggttggtttccgcgggaacacagaggacaggaggggcgggatctgggttgagttcccactctcgttatgaccttcaacctctcactgttcccaagggctgcacggagcctgctgagtctccaacccacctcgctcaccgctctgaccactgacaggcagagcaaaggatgcgggagttgcctctgctgcccatctaaggggacgtaggcagagaagcaaaggcctctgctctccctccatccatcccggtgtgctggccccaacggaacaggagtccttcaactattgcctgccagaagacccaattgcagggactgtagtctgcatctggatgagctgggctgtagattg

SEQ ID NO: 13907 - DNA, 635 bp, Homo sapiens
tgggggacaccttcatccgtcacatcgccctgctgggctttgagaagcgcttcgtacccagccagcactatgtgtacatgttcctggtgaaatggcaggacctgtcggagaaggtggtctaccggcgcttcaccgagatctacgagttccataaaaccttaaaagaaatgttccctattgaggcaggggcgatcaatccagagaacaggatcatcccccacctcccagctcccaagtggtttgacgggcagcgggccgccgagaaccgccagggcacacttaccgagtactgcagcacgctcatgagcctgcccaccaagatctcccgctgtccccacctccttgacttcttcaaggtgcgccctgatgacctcaagctccccacggacaaccagacaaaaaagccagagacatacttgatgcccaaagatggcaagagtaccgcgacagacatcaccggccccatcatcctgcagacgtaccgcgccattgccaactacgagaagacctcgggctccgagatggctctgtccacgggggacgtggtggaggtcgtaaagaagagcgagagcggttggtggttctgtcagatgaaagcaaagcgaggctggatcccagcgtccttcctcgagccc

SEQ ID NO: 13908 - DNA, 475 bp, Homo sapiens
  misc_feature 80: n = A,T,C or G
tccaccgcggtggcggccgctctagactagtggatcccccgggctgcaggaattcggcacgagtcggagaatgtggttancccggaaaatccagtaaatcctatgggtcagcaaatgccaatagaccaaggctttgcctctttacagccatcccttcatcatccttcaactaatcaaaatcaaacaaagctgacacattttgatcactataatcagtatgaacaacaaaagatgcatctgatggatcagccgaacagaatgatgagcaacacccctgggaacggactcgcgtctccgcactcgcagtatcacacccctcccgttcctcaggtgccccatggtggcagtggtggcggtcagatgggtgtctaccctggcatgcagaatgagaggcatgggcaatcctttgtggacaacaactccatgtggggccccagggctgttcaggtaccaaaccaaatacgagccccctacc

SEQ ID NO: 13909 - DNA, 430 bp, Homo sapiens
aaaccttaacccagagttatttttattttccagaacgtgttaggaactagtacttaaataatctcaagtccctgaggggccagagatcccaccatgcaaaatagcaaacagacccaagacttggggagaggcggtgagtgcatcagaaatggatgggtacatctgattcccaccacgcggggctcagcttagttagcaggagaccttcagactgagaaaaaatgcaagtctttttttggcctctaatatctgggaaggatggagggagctcaggagacacagaaaagatggcgtatgaatcctgtccggcctgaacgaggctggagttgtgcctctggatagcttcaagcactgatcagattgtcagcccccgctgcttgaacagatgctttagagcctcttccagttgccggtttgttccctgaagccc

SEQ ID NO: 13910 - DNA, 657 bp, Homo sapiens
acaagctacttgttctttttgcaggatcccatcgattcgaattcggcacgaggccttctctggcctcaccaattaggtcaaatgttccttagaatgtgttgtggggcatggtctctccctgtgaggacctgtccagctggacctccgccttcctgcgactgtattggtgtctttccctctcaagcctatgagctctgcaagggcagggaccctgtatgattttgcctatcgtatgtcctccagcccccagcacagcgcctggtgtccagtgagagctcagcaaatactttgtgagttaaggacaggcggctgggtagatggatcgtctgcctagacagggcagttattccgctgtgagcaactcttagagaaacttcattttttttcggcgcctggccgaaacttcaagatgtttcccggccaggaacggtggctcacacctgtaatcccagcactttgggaggctgaggtgggtggatcacctgaggtcaggagttcgagaccagcctggccaacacggtgaaaccccgtctctactaaaaatacaaaaattagctgggtgtggtggtgggcgcttgtagtctcagctacttgggaggctgaggcaggagaattgcttgaacccgggaggcggaggttgcagtgagtcgagactga

SEQ ID NO: 13911 - DNA, 526 bp, Homo sapiens
caagctacttgttctttttgcaggatcccatcgattcgaattcggcacgaggctggagcacgctggagaggccatccctgccctggcagccgcggctgggggagactcctttgccccattctttgccggtttcctgccattattggtgtgcaagacaaaacagggctgcacagtggcagagaagtcctttgcagtggggaccttggcagagactattcagggcctgggtgctgcctcagcccagtttgtgtctcggctgctccctgtgctgttgagcaccgcccaagaggcagaccccgaggtgcgaagcaatgccatcttcgggatgggcgtgctggcagagcatgggggccaccctgcccaggaacacttccccaagctgctggggctcctttttcccctcctggcgcgggagcgacatgatcgtgtccgtgacaacatctgtggggcacttgcccgcctgttgatggccagtcccaccaggaaaccagagccccaggtgctggctgccctactgcatgccctg

SEQ ID NO: 13912 - DNA, 615 bp, Homo sapiens
ggaacaaaagctggagctccaccgcggtggcggccgctctagaactagtggatcccccgggctgcaggaattcggtacgagcctatttatgaacccaacatgttgggtggaatctctactgggtgttttatcttatctttactttcttaatagatgtatgctttacaaataaacacataataagatgggattgctggggtttttttccctatactaagggtaattttattttactccaatatcttgacctatttatgtttactgtcatgaatatgtaaaatgtataaaatgttcaatattatttatgttcatcttatttcatgcttttggttttgggagaaatctttattttttttcgtgttttcttatagtttcacatcatgttctatttattgtgtcttctgcagtgatatgaaaattgtcaattttaaaaatgtatactggtgattacccttgagttttacattaagacttgaaacaggccgggtgtagcggctcatgcctgtagtcccagcactttgagaggccaaggtgggtggatcacttgaggtcaggagtttgagaccagcctggccaacatggtgacacccggcctctactaaaaatacaaaaatt

SEQ ID NO: 13913 - DNA, 586 bp, Homo sapiens
  misc_feature 156, 458: n = A,T,C or G
tgattacgatttaatacgactcactatagggaatttggccctcgaggccaagaattcggcacgaggcgcccgggcatagcaccatgcctgcttgtcgcctaggcccgctagccgccgccctcctcctcagcctgctgctgttcggcttcaccctantctcaggcacaggagcagagaagactggcgtgtgccccgagctccaggctgaccagaactgcacgcaagagtgcgtctcggacagcgaatgcgccgacaacctcaagtgctgcagcgcgggctgtgccaccttctgctctctgcccaatggccaactggctgagtgattcgaagaaagtgaggaatcctccctggacactgtatcgcccttcgtcgtctttcagtcaatctcttccactctaaggattgagtgagcgcgagctggggactctctctgagataaggagggttcctgcccccangtgaacattaactttccccagctcggcctctgtcgggaccagtgccaggtggacagccagtgtcctggccagatgaaatgctgccgcaatggctgtgggaaggtgtcctgtgtcactcccaatttctg

SEQ ID NO: 13914 - DNA, 660 bp, Homo sapiens
acgccaactcgaattaaccctcactaaagggaacaaaagctggagctccaccgcggtggcggccgctctagaactagtggatcccccgggctgcaggaattcggcacgagggaattccacgggttattctgtcggcatctatcactctctgtgtggtcctctacttcatcctcatggcccaaagcatccacatgtatgcagccagggtccagtggggcctggtcatgtgcttcctgtcttattttggcacctttgccgtggagttccggcattaccgctatgagattgtttgctctgagtaccaggagaatttcctaagcttctcagaaagcctgtcagaagcttctgaatatcagactgaccaggtgtaaaccatcagtttttccttgctggtgaggtgggtgtgacagtgggggaggggccagtaggacacactcacaggacttgacatagaacctcatttcacacacacacacacacacacacacacattcatggccacatttgccaaatgagcttttcagggcgagttatttctttaatgaaaaagcacaagcccttatgtgtcgaaatacacgctgttacactgaatatatatgcacgacagagcaagaagcttgtgcatgatcacttcttatccgtccccttcccagcactccc

SEQ ID NO: 13915 - DNA, 508 bp, Homo sapiens
tatgacgtcgcatgcacgcgtacgtaagcttggatcctctagagcggccgcctactactactaaattcgcggccgcgtcgacgagcctcaatcctgtccacataaaggagtggagcccggtccccctccagggaggggaaagaactcgtgtccagggatccacgccatggcagacgtgggctcttggggtagcaggagccgccttatgggggaatagggctcagctggtgacaccttctgcccacaggtgccaagtcctgccctgccaacttcttggcagctgccgacgacaaactcagtgggttccagggggacttcctgtggcccatactggtggttgagttccaggcggcacgcggcctccccatagcgccagtgcttggggggatagaggtagggtcgacgcggccgcgaatttagtagtagtagtagtcgacccgggagttccggaccggtacctgcaggcgtaccagctttccctatagtgagtcgtattagagcttggcgt

SEQ ID NO: 13916 - DNA, 747 bp, Homo sapiens
  misc_feature 1, 9, 590, 676, 685, 701, 714, 725, 729, 734, 738: n = A,T,C or G
nacgacagnagggacaagcagcctttggggtccatcctgtgatgagcttgatcaaattgtggaaagctgtcttcttcctgagctgaatgtgggagattggcttatctttgataacatgggagcagattctttccatgaaccatctgcttttaatgattttcagaggccagccatttattacatgatgtcattcagtgattggtatgagatgcaagatgctggaattacttcagactcaatgatgaagaacttcttctttgtgccttcttgcattcagctgagccaagaagacagcttttccgctgaagcttaaacaggcattaacgcttctttagatctgaagttgcaggttaagcttgtctggtcaacattccagtgtggaaaaataatttaaacaatcttattctcttaattcttttggcaacaaaaactattagtaatagctatttgggaccagacaaaatcagctttcatctataattcattggggataatgggagatttagataatgtatccagatttaaacctaccagtatgtcctaccccttaagcgtttaaaataaaatatgcaacaaaatggatgacttantggagatggaagcccattaattgggttccccattaaatcgtttacatacaagaacacagttttatactaaggatttgtgttaaagncttgaaagntcatgtctttcaccanaatatcaaaggtnaagacaggggnctcntaganatgntagggattc

SEQ ID NO: 13917 - DNA, 322 bp, Homo sapiens
  misc_feature 37, 55, 85, 89, 96, 106, 125, 188, 198, 218, 219, 225, 228,275, 276, 282, 288, 292, 298, 305, 310, 315, 316, 322: n = A,T,C or G
ggggcatatggctacacgtttttatttatttgagacngagttttgcttttgtcgnccagactggagttgcaatggcgcgatctcngctnactgcancctctgcttnttgggttcaagagattctnctgcctcagccttcctataggtgggattccaggcccgcgccaccgtgcccggttatttgtgtnttttagtaanacagggttaccatgttggcnngctggnctngactcctgactaagtgatccgcctgctcacctccagggggggattcnngcgtgncccccncccncccccnttttttntgaancggtnnaaaccn

SEQ ID NO: 13918 - DNA, 518 bp, Homo sapiens
tggactccaccgcggtggcggccgctctagaactagtggatcccccgggctgcaggaattcggcacgaggggaatttggagcctgaggaggccaaactgatccgtgtccctcttcaacgaatccaccttggacacagaatcttaaacccactgaatggatgggaacagctggcagagctttctaggacctccacctctggtggcaacccctcctttgtgcctctctccaagttcatgaacacccagtattttggaactattggtttgggaacgcctcctcagaatttcaccgttgtctttgacacgggttcttccaacttgtgggttccgtccacgagatgtcatttcttcagtttggcatgctggtttcaccatcgctttaatcccaaggcctccagctccttcaggcccaatgggaccaagtttgccattcagtatgggaccgggcggctgagcggaatcctgagccaggacaatctgactatcggggggatccacgatgcttttgtgacatttgg

SEQ ID NO: 13919 - DNA, 588 bp, Homo sapiens
  misc_feature 505, 568: n = A,T,C or G
acatgtctattttttattcaatatattaaatatattaatcagaaaagtcacatactataaatccaggaaaatacacaaatataaatgtcagaatctgtcatttgtcttcttcctagagtgacagtttatgtacatgtggaaggagggtaggaagagagagccagcaggaggctggaaaggctgcccaggaaggcggggcccatcccttcctcccagccccgctcccacctcaagctctttcttcctgtatttacagcagcactgggcttatttacagcacggcgctatgtgttaaaaacggtttatcttacaaaaaacataaaggccggggccaggctgggggggataagacaaatcgtggggtcacccccatgaaggcatccccctccccaagggcttgagctccctgcaaacctcctggagcaggtgagaaggtggagtcattctgcagctcaagcccaggctttgggggtgctctgggggtcgtggactaaaggcacatggngtggcatatgagagtgcgcatgtgcacacgtggttccaggcaagggtcagaaaggcagcgtgnccatgaagacttgtccatga

SEQ ID NO: 13920 - DNA, 682 bp, Homo sapiens
gcggccgcccccgcccgtctcctctgtccctgggcccgggagggaccaacttggcgtcacgcccctcagcggtcgccactctcttctctgttgttgggtccgcatcgtattcccggaatcagacggtgccccatagatggccagctttcccccgagggtcaacgagaaagagatcgtgagatcacgtactataggtgaacttttagctcctgcagctccttttgacaagaaatgtggtcgtgaaaattggactgttgcttttgctccagatggttcatactttgcttggtcacaaggacatcgcacagtaaagcttgttccgtggtcccagtgccttcagaactttctcttgcatggcaccaagaatgttaccaattcaagcagtttaagattgccaagacaaaatagtgatggtggtcagaaaaataagcctcgtggaacatatatagactgtggagatatagtctggagtcttgcttttgggtcatcagttccagacaaacagagtcgctgtgtaaatatagaatggcatcgcttcagatgtggacaagatcagctacttcttgctacagggttgaacaatgggcgtatcaaaatatgggatgtatatacaggaaaactcctccttaacttggtagatcatactgaagtggtcagagatttaactcttgctccagatgga

SEQ ID NO: 13921 - DNA, 603 bp, Homo sapiens
cggcacgagggccgtcgcagccgtggcatcgttgaggagtgctgtttccgcagctgtgacctggccctcctggagacgtactgtgctacccccgccaagtccgagagggacgtgtcgacccctccgaccgtgcttccggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgat

SEQ ID NO: 13922 - DNA, 367 bp, Homo sapiens
  misc_feature 19, 66, 76, 247, 256, 270, 297, 346: n = A,T,C or G
ttgttgttttttgtcagcntttgggcactttttctgggcaaccgtggcggcgtgtgcactccagtnttgccaaggntggggatacggggggccagggtgggggtcagggagggtttccagcgcaggaggggagggctgtcggctcccagcctttccaccagggcctggctggctggggctggggcggagggccacgggagctgcgaggctgcggacaggagtctgcggcctctagtacttagcgatntcccccttnttcaggatgacctntcgctgccagggcgccacttagctctnatcgtagcccagcgtccgcagcttctctgactgttccttctcccgccgnagctcctcctgcttcttgtcg

SEQ ID NO: 13923 - DNA, 593 bp, Homo sapiens
tccaccgcggtggcggccgctctagaactagtggatcccccgggctgcaggaattcggcacgagggttaatggtcatggtcacctggtcactccaacaatatctattgtttcgtacctctttgctaaatcgaacactgtatacaatccagtgatttatgtcttcatgatcagaaagtttcgaagatcccttttgcagcttctgtgcctccgactgctgaggtgccagaggcctgctaaagacctaccagcagctggaagtgaaatgcagatcagacccattgtgatgtcacagaaagatggggacaggccaaagaaaaaagtgactttcaactcttcttccatcatttttatcatcaccagtgatgaatcactgtcagttgacgacagcgacaaaaccaatgggtccaaagttgatgtaatccaagttcgtcctttgtaggaatgaagaatggcaacgaaagatggggccttaaattggatgccacttttggactttcatcataagaagtgtctggaatacccgttctatgtaatatcaacagaaccttgtggtccagcaggaaatccgaattgcccatatgctcttgggcct

SEQ ID NO: 13924 - DNA, 600 bp, Homo sapiens
tccaccgcggtggcggccgctctagaactagtggatcccccgggctgcaggaattcggcacgagcatagcaagaccctgtctctacaaaaataaacaaaaaacagaaagaaagaaacagtctacttagagttaatattgtaccactttatgtaaaatgttgaagcctgacaactgcatagttccatttactgctcctgctttatgttatagtttaaaatatatagaacctctatatatgttataaattccacagcacaaggttttaatttttgctttaaactatcatatgcatttttaagttaagaagaataatagtttttaaatatttactgtttctaatgctcttgattccttttgaagatacaggtttccaaatggtatcattccacttcagcctacagaacatcttttaatatttcttatagtccacattggctggctgtgtaaaaagggtgtgttagaaacacatttttagcattttttttaattggacaatgtcagattcctggaggatattttcactggatgtcaagttctagattgctagttttgtctctcagtcctttaaagatgtggtttcgtctctactaaaaatgcaa

SEQ ID NO: 13925 - DNA, 303 bp, Homo sapiens
  misc_feature 26, 35, 60, 117, 170, 174, 181, 188, 189, 196, 197, 198,201, 207, 222, 240, 246, 255, 264, 276, 287, 290: n = A,T,C or G
gggggtttagaaacatgttatagcanttcttgctntatagcatactataataaccagcantcattccactgtcctgccaaggtacacctcattactccccttcccactgaagtggtntgaggctagctctttccaaagccttccagtttggcttctgatgtgactcatantttnggaaccngatgctnnatcaatnnnctntgaaantctgaggaccttgtnggaagggttgttaacctnttttantgcctgatnaccttacanccggccgggggntcccccttatnccnccctttggaggcc

SEQ ID NO: 13926 - DNA, 782 bp, Homo sapiens
  misc_feature 1, 696, 713, 716, 720, 738, 754, 776: n = A,T,C or G
natgcttaaaatagcagaagatctgggaggaccgtatgtatggggacagtatgacctattggtcctgccaccatccttcccttatggtggcatggagaatccttgccttacttttgtaactcctactctactggcaggcgacaagtcactctccaatgtcattgcacatgaaatatctcatagctggacagggaatctagtgaccaacaaaacttgggatcacttttggttaaatgagggacatactgtgtacttggaacgccacatttgcggacgattgtttggtgaaaagttcagacattttaatgctctgggaggatggggagaactacagaattcggtaaagacatttggggagacacatcctttcaccaaacttgtggttgatctgacagatatagaccctgatgtagcttattcttcagttccctatgagaagggctttgctttacttttttaccttgaacaactgcttggaggaccagagattttcctaggattcttaaaagcttatgttgagaagttttcctataagagcataactactgatgactggaaggatttcctgtattcctattttaaagataaggttgatgttctcaatcaagttgattgaaatgcctggctctactctcctggactgcctccataagcccattatgatatgactctgacaatgcttgattgccttagtcnaagaggatactgccaanaanaganttaattcttcatgcccanacctgaggtctttttntatcatgaagagttttaaccanacctca

SEQ ID NO: 13927 - DNA, 275 bp, Homo sapiens
agtgaacagttacagaagaatggtctgagaaaaaatggtattttgaaaaatggcttgatctgtgacttcaagtttggaccgtggaagaacagcactttcaaacccacaactgagaatgatgacacagagacaagtagcagtgattcatcagatgacgacgatgtgtgaaggatttcctaacagctttagaaatcttagtgtgatacatctctcatacagtttggggtgaattgtaaaaatgaagaactataatttatgtagtgaaataccccatt

SEQ ID NO: 13928 - DNA, 750 bp, Homo sapiens
  misc_feature 22, 519, 554, 581, 601, 621, 627, 629, 668, 695, 727: n = A,T,C or G
aagttgtagtcactgtctgagnaatggctatgaagcgtcatttcacattttaccccaactgacctgcatgcccaggacacaagtaaaacatttgtgagatagtggtggtaagtgatgcactcgtgttaagtcaaaggctataagaaacactgtgaaaagttcatattcatccattgtgattctttccccacgtcttgcatgtattactggattcccacagtaatatagactgtgcatggtgtgtatatttcattgcgatttcctgttaagatgagtttgtactcagaattgaccaattcaggaggtgtaaaaataaacagtgttctcttctctaccccaaagccactactgaccaaggtctcttcagtgcactcgctccctctctggctaaggcatgcattagccactacacaagtcattagtgaaagtggtcttttatgtcctcccagcagacagacatcaaggatgagttaaccaggagactactcctgtgactgtggagctctggaaggcttgganggagtgaatttgcccacaccttacaattgtggcangatccaaaagagcctgtcttttatatncattccttgatgtcattggnctctccaccgatttattacngggccncncagtcttggtctgggtagtccggaaacaaaaggaggganacagcctggaatgaataaaaccttacncagtttctctgggaaaacataaaaaccttctnttttttttctttaaaataaaaag

SEQ ID NO: 13929 - DNA, 243 bp, Homo sapiens
  misc_feature 4, 13, 22, 26, 28, 31, 32, 40, 49, 59, 60, 69, 82, 100, 104,114, 126, 130, 150, 155, 159, 164, 169, 184, 187, 192, 194,198, 207, 231, 239: n = A,T,C or G
aggncccgctgtntagcattcnccananagnntctgctgntagaacacntcgcctgggnncggctgctnaatgactacatgnagggtgcgggcctgctanctcnctacagtaangttgctgtatgncgtnattacgacgagaatgccacnttctncatnaaagncgacntaaacggtacggatngcntgtantnctgnctccaatgntatgggactgccctgaagtactancacaaggnccct

SEQ ID NO: 13930 - DNA, 533 bp, Homo sapiens
ttacttaaataatctttatttctcatgcactaggaaagatggttcgtatgaaacactgcagttcacagcaaaggcctcagtccagaacacaacataggggccagctgggatcacaatctggtcaaagctctgggagccacactgggaacaccactcccggggttgagtggcagatccaggactttgcagcaactgtggccccagacataacacaaggcagctgcctctcccacagaggcacaggaagctgacacccaaggagcacgtgggctggggacaggacggagaaggctgctgggcagtgacttggcggagatgtggtccagcacctctgccgcctgcgtctacccactcaggccaggaagcccaggcctgtgactgagctctaggcccagctctacccagtgcagagctgctggagttccacagaccctcagcagccccgtgcccacagcagaggtgtagaagttccccgcctgcccctcggctacatgaacaagacaggggcctaaacttcggacctggcaaggctt

SEQ ID NO: 13931 - DNA, 501 bp, Homo sapiens
  misc_feature 342, 363, 415: n = A,T,C or G
tccaccgcggtggcggccgctctagaactatggatcccccgggctgcaggaattcggcacgaggaggaatttatccatttcttctagattttctagtttatttgcatagaggtgtttgtagtattctctgatggtagtttgtatttctgtgggatcggtggtgatatcccctttatcattttttattgcgtgtatttgattcttctctctttttctctttgttagtcttgctagcggtctatcaattttgttgatcctttcaaaaaaaccagctcctggattcattaattttttgaagggttttttgtgtctctagttccttcagttctgctctgattttanttatttcttgccttctgctancttttgaatgtgtttgctcttgcttttctagttcttttaattgtgatgttanggtgtcaattttggatctttcctgctttctcttgtggtcatttagtgctataaatttccctctacacactgctttgaatgtgtccc

SEQ ID NO: 13932 - DNA, 93 bp, Homo sapiens
gcaccacgcatgtctggccgagcctctggaatgagcactcctctgctggggagatggtctccacctgcactcccatgggagcggccgatgctg

SEQ ID NO: 13933 - DNA, 300 bp, Homo sapiens; identical to SEQ ID NO: 11072

SEQ ID NO: 13934 - DNA, 525 bp, Homo sapiens
aagtttgtacaaaaaagcagctggtaccggtccggaattcccgggatatcgtcgacccacgcgtccgatcttactaagttaaaaaacttttttgaacttttctgaatagaaatgttcttggaattcgtcgtgcacatgattgttcataattactaattacaaatattactaattattatttctattatatataatatgtataatattattaattattcataattactaattgaaatagagacgctagttgttggggtaacaaaagtagtgcatttttgagatgaagctggctttcagtacaaacatattctaaattatgctggtggctatgcagtttttctctgtgctggtcatcaacaattagatttagatgtgtttgagcacttgaagaagtactatgaaactgaacttaaataaaagtatttagcaattgtgatgccaaaaagctttagcttgtgaagctttatcaatttccaattcttaaaagcaaaggttgtaaagaggaagacattgaaactgatcctt

SEQ ID NO: 13935 - DNA, 510 bp, Homo sapiens
aaatgtgattttgttggcatctagaaccagtgtattttttatttatgtactgaaaaataatcattgtggggttttaaaatgaaaaatcatgtacctaatgcctatcgctatatgaaattgttatgttagggaaaatgggtacttaatctttgctttattacatagattatgataaaaatgttaaaggtctcctgagtgaaattttaaaccttcaaatgactacacaaggtaaatacatattttataggcctatacctcatataatcgacaagctgaaagagttctttaagatctaactataagtcctctggtctatagaatgactgagtgaggcttgggtttcacctctggcttcttaactagctatgagactctgggcagttcatttgtaccctctaaggttgtcagttaattcatctgtaaaagggaattaatgccatctatctcatggagttgttcattttgttcatttcaacaatatttattgagtgcttatctgtgtatgatgct

SEQ ID NO: 13936 - DNA, 183 bp, Homo sapiens
ggtcttttcttggcagctacaatctctggtatcttgaaagtcaaatctaattgaataggaaataaatgcatgctggtaactctggggattttatttccctaatttctgctattgctgcaaataaaaaaaaaagttaccaattttttagcccaggcattcaccaagcaataacaaaaaccactt

SEQ ID NO: 13937 - DNA, 452 bp, Homo sapiens
ctggctgccaggaactgtgtcattgatgacacacttcaagttaagatcacagacaatgccctctccagagacttgttccccatggactatcactgtctgggggacaatgaaaacaggccagttcgttggatggctcttgaaagtctggttaataacgagttctctagcgctagtgatgtgtgggcctttggagtgacgctgtgggaactcatgactctgggccagactccctacgtggacattgaccccttcgagatggccgcatacctgaaagatggttaccgaatagcccagccaatcaactgtcctgatgaattatttgctgtgatggcctgttgctgggccttagatccagaggagaggcccaagtttcagcagctggtacagtgcctaacagagtttcatgcagccctgggggcctacgtctgactcctctccaatcccacaccatc

SEQ ID NO: 13938 - DNA, 611 bp, Homo sapiens
  misc_feature 544: n = A,T,C or G
gattccaaatgccccttttattaaaaataattgcacttaaaatttaaaatctcccaagtcctgtgaattttcctgagttcccaggcttgctcggggaccggcaggcatccagccctctgggcagccgggcagcggtcgcgttggggcaaagcagcaggcgcgaagcaggagctcaggtgcataccccacacctccacctgagcacccccttctccggtgctgggaacagatggaggggggtggctaatactacccgcatgccggcaacaggtgaggagggcaaaccttacaatcttattaacacagagcagccctccagggccccagcccacagtgcgatctagggagaaagctctcctagacacgttgggggccagagccccggcccaggaggtggaaacaagcgatgcggcggcttggaatggttagtgcccagctccaggtgacacatgcaacccccaggcccgcacacagctgctgcccgcacacaggctctgcttccctggggaaccagcctccctctggagagactaacacactccgncccgctaacaccagctgacgagaaactgctctcccatcaacagcgagacacagatgtccaggacctt

SEQ ID NO: 13939 - DNA, 381 bp, Homo sapiens
cggcacgaggccgccatcgtggtgtgttcttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttcttttt

SEQ ID NO: 13940 - DNA, 729 bp, Homo sapiens
  misc_feature 12, 577, 601, 614, 657, 681, 686, 701: n = A,T,C or G
gggatcacaagnaagacagcatatatcagaacgtcctgtaatcatttagttagaaactaactactaactagtctttggaattcgtgacctatggagacagtaattatcaatttattgattctattgatttctcaaattaggaattaacttatgtggattttgcttcctcttgtattctgattgcccttcatcccaagtgtttactgaaaattccattctagatattcttgttttgacaaatgacactacagtctcgtaatattgtcttttatgtatatacaaaatttacctttttactagcatctgagatagagttactttctggtacccagtatattggagtctgtcagaaactctataataggccaccagtttttattatttaacatttttatttgaatttctaagaagcctattctctatctattttgaaagattttggcactatatttaattggaaggtaaaatattgtacatgtgatccagagtaaatgagaagtctctatctgagctggtcagttactggagtacatgttactaatctgggtttaaaggttacttcattatctgctagtgncatccacagcagttcatcctcatncacactaagcctnctgttagcttttaaaggaggtaatttaattaacataatatacnctatgggctccctcttccacctgnctgcntagaaggccgaatanactagctgctttggaaacaatagaatgt

SEQ ID NO: 13941 - DNA, 192 bp, Homo sapiens
gactcactatagggcgaattgggtaccgggccccccctcgaggtcgacggtatcgataagcttgatatcgaattcctgcagcccgggggatccactagttctagagcggccgccaccgcggtggagctccagcttttgttccctttagtgagggttaatttcgagcttggcgtaatcatggtcatagctgtt

SEQ ID NO: 13942 - DNA, 647 bp, Homo sapiens
gtaatacgactcactatagggcgaattgggtaccgggccccccctcgtgccgagagggagaaaacttcttcctggcctgggctccgtgccgctctgtttgccaaccgtccagtcccgcctaccagtgccgggcgctccccacccctcccccggctcccccggtgtccgccatggccaaagcctacgaccacctcttcaagttgctgctgatcggggactcgggggtgggcaagacttgtctgatcattcgctttgcagaggacaacttcaacaacacttacatctccaccatcggaattgatttcaagatccgcactgtggatatagaggggaagaagatcaaactacaagtctgggacacggctggccaagagcggttcaagacaataactactgcctactaccgtggagccatgggcattatcctagtatacgacatcacggatgagaaatctttcgagaatattcagaactggatgaaaagcatcaaggagaatgcctcggctggggtggagcgcctcttgctggggaacaaatgtgacatggaggccaagaggaaggtgcagaaggagcaggccgataagttggctcgagagcatggaatccgatttttcgaaactagtgctaaatccagtatgaatgtggat

SEQ ID NO: 13943 - DNA, 514 bp, Homo sapiens
gcgaattgggtaccgggccccccctttttttggtctgtagtctttacttggggttaagagttctgtgaacaagagggaacagaaaagtcaatcaggtagacagccaaattttttttattggggaaatgggtctctagggggtaggcctaggccctcactgcacagcttgttcattggcactgcctccagaatcctgtggcttcatcacatctggaagctctggagggctggaaaagggctcgatgcggagagcttcgaaggtgtcatctgctcggaaggccaggcccactgtggctggggcctgtggccgtgctgtctggctagtgaagccacactcgcccagagttttgccatcatcaaggagctggtcatccttgtaaagccgctgctcctctggcggccgcttgaggatgccctcgacgatgcgcttcagttcgaacacggtgctcgactccttggcgtccgtaaagatggtggtcttgtggcgccgctcgtgccgaattcctgcagcccg

SEQ ID NO: 13944 - DNA, 800 bp, Homo sapiens
  misc_feature 4, 11, 13, 22, 33, 35, 49, 56, 66, 68, 77, 107, 210, 251,584, 677, 696, 698, 705, 710, 714, 734, 766, 788, 791, 796: n = A,T,C or G
ttantttgggncnaaaaacccnccttttcttgntncttttggaccgcancggcctncggctgcganantacgacagnagggttgcattgctatccgtgggatacagnacgcttagctcttaaaagatttttttttatgtaaactgttgaatatttgaaatagtccacttcaccttaatgggtcttgtctatcttcattagtcctcaaagnaaaaaccatttgctaccaaagtaaatcagtattttgaatgngcttctcttgttttttgtttattagctagttcctgtaagcatttccaccagaacttgaggcaaatcgtaaggaagctgtttcttttaaaacacaaaccaccaccaaaaatttaaatgtacatattgcttaagtatttggctgtttttattttttaaaaggtataaacaccaaaaaaaaaattaacattgtatgaagatggaaaataagaagatgcactttctgtaactttgtctaaggatttaaattactaacttatgaactccaatttgaattgaacttaactatcggctttcttactggtaaaattatatggtttattttaaatgcgtacntattgaccaatggcctctgaaaaagcacattttagatactgaaattgaaggaaagaaaatgcatcttcaaacattttttggaatctcaccacntttactttgttagatttgngnattgganggggnttgntttgatttttgattggatanaaccttttttaaagggacaggttaaacacatntttaaagctagtccagacaaangcntcagnataa

SEQ ID NO: 13945 - DNA, 765 bp, Homo sapiens
  misc_feature 574, 581, 692, 703, 713, 718, 737, 745, 750, 751, 755, 761: n = A,T,C or G
tttgtttacagctgttgtcgcatctgcagatcgatctgaatagaaaacgtcaactctgtggaggctttgcaggaaactctcattcgtgcactaaggaccttaataatgaaaaaccatccaaatgaggcctctatttttacaaaactgcttctaaagttgccagatcttcgatctttaaacaacatgcactctgaggagctcttggcctttaaagttcacccttaaggcctttgtttatttaaacatgaactgatggtaactgtacattttgtgctaaaatgcatatttatatgtgtataccatatgtggagatagaaaagacctttaagacaataaaagattgtaggctatctctgtaatcatgcaatagctgttcggattgagaactcttcagccatgattagacgttgactgcatctccctgatagaccaatcagctgtgtcgcacttaaactggagaagttacactgaagtataatcacactgaatgttagactttttcatctgccaaaaccaaaaaccattttgatctccctgtggttatcaatataacgcacaatcacaagtgtatgangacttanaaattaatcctttgtggtaggagttctgttgaatgatggaaatcttatactaccacaagactatttgatctggtaattggagacttcgggatttagagaactcctgtctgnattactctacnctgctaaggnggggnctgggtagttacttgctgnggaaaganaatgnngggnccccangccc

SEQ ID NO: 13946 - DNA, 686 bp, Homo sapiens
  misc_feature 536, 551, 571, 580, 601, 607, 625, 642, 649: n = A,T,C or G
tcagaaagacccaaaacctttattgtccctaccagggagccagtgcttccagcccacaccccacaccccaggagcttcagcaaggtctctgcttgggaggatgctgcccagaactgcagccagggccaccggtgccacctgcaggcttcctcccattccagctaggcagtggccaggctgccccctgaccagccccactgggaaggcagcaggatggcagtggccagtggggtcaggctgggccatctccctctcagacctcagcacctgggtcctcggggctgctgctcttgttccggaagtggtctcgactccgcttcctgctgccatggaagccaacagtttccaccggcgggagacctggcacagacccactgtggacagaccctgacagtgcctccacctcctgcaggcctccatgggggctgccccaactcctcagcctctgggctcccgggcccggccagatgggcagctccacagggcctcgccctgtctgtggcaggattccaaggccgccctgctggctttccaantttcccaggaacctnttctctgtgtttgctttgancctcgaatngtttgtgaaataacttccttnccaaantgaaggatttgtttaagngaaagcataattggggnagcagtntggagccagaagcaagggtgtgattttgttgctaatc

SEQ ID NO: 13947 - DNA, 271 bp, Homo sapiens
gcgaattgggtaccgggccccccctcgaggtcgacggtatcgataagcttgatatcgaattcctgcagcccgggggatccactagttctagagcggccgccaccgcggtggagctccagcttttgttccctttattgagggttaatttcgagcttggcgtaatcatggtcatagctgtttcaatcccctttttaaatgtacttagtgggatcaacaattaaacgtatcatgtagatatgcctagtgacactctgaaggtgccatttatata

SEQ ID NO: 13948 - DNA, 473 bp, Homo sapiens
tccaccgcggtggcggccgctctagaactagtggatcccccgggctgcaggaattcggcacgaggcgttgaagctattttatagaacctagctcttatagctggacaaaccatgtttcccatcttcccttcctctacttcccctggatttcttttttttaatttatttttttaattttttggagaaaagagtcttagtgtcgcccaggctggagtgcaatggtgcgatctctgctcactgcaacctccacttcctgggttcaagtgatcctcctgcctcagcctcccgagtagctgagatcacaggcatgcaccaccatgcatggctaatttttatatttttagtagagacggggtttcaccatgttggccaggccggtctcaaactcctgacctcaggtgacccacccactttggcctcccaaagggctgggattacaggagtgagccaccatgcctggccttttttgtttg

SEQ ID NO: 13949 - DNA, 610 bp, Homo sapiens
tcggcacgagcctgaacctctacgacacggccgggcaagaagactatgaccggctgcggcccctgtcctaccagaacacccacctcgtgctcatctgctatgacgtcatgaatcccaccagctacgacaacgtcctcatcaagtggttccctgaggtcacgcatttctgccgcgggatccccatggtgctcatcggctgcaagacagacctgaggaaggacaaggagcagctgcggaagctccgggccgcccagctggagcccatcacctacatgcagggcctgagcgcctgcgaacagatccgagctgctctctacctggaatgttccgccaagtttcgggagaatgtggaggacgtcttccgggaggccgccaaggtggctctcagcgctctgaagaaggcgcaacggcagaagaagcgccggctctgcctgctgctctgacccagggcagacagacctcacgacagcactgacagggcccgggggcccaggtgccgattgcaccagggaggctgccccatcccgaccctccagctcatggtgtctggggcctgcggctagactcttggaacattctggaactctctcctttcctggctggggctctg

SEQ ID NO: 13950 - DNA, 569 bp, Homo sapiens
  misc_feature 5, 363, 402, 438, 512, 519, 557, 563: n = A,T,C or G
gccgncaccgccaaaaaagtcaccgccgctagggtcgccgttgcatcggtgcagggcaagatggcatccgccacagactcgcgctatgggcagaaggagtcctcggatcagaacttcgactacatgttcaagattctcatcatcggcaacagcagcgtgggcaagacgtccttcctcttccgctatgctgacgactcgttcacgcctgccttcgtcagcaccgtgggcatcgacttcaaggtcaagaccatctatcgcaacgacaagaggatcaagctgcagatctgggacacagcagggcaagagcggtaccgggaccatcaccaccgcatactaccgggggcgccatgggtttcattcctnatgttttgacattcaccaacgagggattcctttcaatgncagttgcagggattggttccacccagtttcaagacntattcttgggggacatttgcccgggtgttggttggtagggaaacaagttttgacttgggagggttgagcgggtnggtgtcntcagaaacgttggccggcagttaggttggaccactttngggttngatttt

SEQ ID NO: 13951 - DNA, 586 bp, Homo sapiens
tcggcacgaggggccaacgccaagtaggggattgcgttccctccagtcgcagagtttccctcttgtcgcccaggctggagtgaagtggcacgatctcggcttactgcaagctccgcctcccgggttcacgccattctcctgcctcagcctcccgagtagctgggactacagaccctatcagatttggatatgtccttcatatttgattggatttacagtggtttcagcagtgtgctacagtttttaggattatataagaaaactggtaaactggtatttcttggattggataatgcaggaaaaacaacattgctacacatgttaaaagatgacagacttggacaacatgtcccaacattacatcccacttccgaagaactgaccattgctggcatgacgtttacaacttttgatctgggtggacatgttcaagctcgaagagtgtggaaaaactaccttcctgctatcaatggcattgtatttctggtggattgtgcagaccacgaaaggctgttagagtcaaaagaagaacttgattcactaatgacagatgaaaccattgctaatgtgcctatactgattcttg

SEQ ID NO: 13952 - DNA, 573 bp, Homo sapiens
caagctacttgttctttttgcaggatcccatcgattcgaattccgttgctgtcggacagattgccctagtacccacccacctatcagggttatgcaatggaacatcctcgcccaagctcttggagaaggcaaagacaactttgtacagtgccctgttgaagcactcaaatgggaagaaaggaaatgtctcatcctggaagaaatcctggcctaccagcctgatatattgtgcctccaagaggtggaccactattttgacaccttccagccactcctcagtagactaggctatcaaggcacgtttttccccaaaccctggtcaccttgtctagatgtagaacacaacaatggaccagatggttgtgccttattttttcttcaaaaccgattcaagctagtcaacagtgccaatattaggctgacagccatgacattgaaaaccaaccaggtggccattgcacagaccctggagtgcaaggagtcaggccgacagttctgcatcgctgttacccatctaaaagcacgcactggctgggagcggtttcgatcagctcaaggctgtgacctccttca

SEQ ID NO: 13953 - DNA, 770 bp, Homo sapiens
  misc_feature 3, 7, 9, 12, 353, 425, 531, 608, 637, 647, 652, 687, 698,703, 716, 723, 729, 734, 747, 758, 769: n = A,T,C or G
ttnaaancngcnttggactccttgcaggatcccatcgattcgtttaaactgagctccaaatgacgttcaaacacccctctcgggtagagttttcatggtggaacggttgcgcccaccaaacagaagcttatgtttttggcacagaagcctgggccattttcatggacacctggctggacctcggtggaagtgaactccgtaggttgttgcgttcactgcagcacctcacatgataccgtcccctctcatggaacggagcctcccccatgcagcccccactcaaatggagttttaaaggctgggttcaggttacgggggcgtttctcaccgtctgaatgcggaggacagagacnagctccagggagcgtgggcgggtgacggcgctgagatgcgtgatgtctcggaaacgtcctcgcatccctcancgcgggcgctgactgccgcggcccttgcctgtcttcaggagcgctccagcttcgcccacacaccccgggctgatgtcccctcgctccggcggcctgcagaccccanagtgcctgtctcgggagggctccccattcacacgaccctgagtttgggtccaagttagcttctgtcccaaagtaccngtattcccaaagcgcacccggtaaagganccgggccggnccttntttgcggggccgggggccggggccgggaactcgtngggggttgccnggaanggggttaaccgtnccggttnttccgnccttncgtgcaaggcttnccccgttaagnggcccaaaccnt

SEQ ID NO: 13954 - DNA, 573 bp, Homo sapiens
acaaaagctggagctccaccgcggtggcggccgctctagaactagtggatcccccgggctgcaggaattcggcacgagcctggctgcaatctgactttttatgggaaatctcccaatgattaaatgatggcaactaacaacaacaaaaccactgtgggcaaaacaaaatgcttctgcagactcaatttgttttatgagcaggtggtttggaaccctagacccagagggttatattgataagggttctagggtgtcctttagaatccattacgatcctctaaagagtgtgcccctaacctgtgctgggctctgagggcacaacgggggtctggggcatggcccctgccctcaaggctgtatcatagctgccctcaagctagatgggtcaaatcagttatgcacccagagccaacttacaacaaaaggactaggtgctatagagctcagaggagggagaggtcagggaatggaggaggccatgtgaaaaggcctcctggagattctgggccttgtgttggttctcagacaggagggtaagacttagtacaaccaaagaaggtaaggggcatcctg

SEQ ID NO: 13955 - DNA, 680 bp, Homo sapiens
tacgccaactcgaattaaccctcactaaagggaacaaaagctggagctccaccgcggtggcggccgctctagaactagtggatcccccgggctgcaggaattcggcacgaggtttttaaagcagagctgagcacacactggatgcgtttgaatgtgtttgtgtagtttgttgtgaaattgttacatttagcaggcagatccagaagcactagtgaactgtcatcttggtggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtattaaagatttccattttgttttactaattgggaacatcttaatgtttaatatttaaactattggtatcatttttctaatgtataatttgtattactgggatcaagtatgtacagtggtgatgctagtagaagtttaagccttggaaataccactttcatattttcagatgtcatggatttaatgagtaatttatgtttttaaaattcagaatagttaatctctgatctaaaaccatc

SEQ ID NO: 13956 - DNA, 704 bp, Homo sapiens
ttctttttttgaattttaaagtttatttactttgaagtaaccaacttaaaaaatggcctgagttaagtgtattaaaaagaagaaatagtcgtaagatggcagtataaattcatctctgcatgtagaaaccggaaaaaaagcaagttcagtacttcaccaaaaaatttcaacattgcaaacacaggaaattgagaactgacaaacagaaatactaggaaatgcaaagtcttgaagctccaaaacaaaaacagcaatcttggaaaggcccctaatctaccttctcaatggttgggggctgtacccagaaccctccctttggaccctgagccccgaagcccccaggcccgggaccaccggcaccctggtacagtccgctgatgatggggttacacacctgctccagctccttcctcttgtgctcaaactcgtccttctcggccaaggtgttggcgtccagctacgagatgacctcttgacacttgtccagcaccttcttcttgtcggcctcgctgatcttgcccttgagcccctcatcctccacggcgctcttcatgttgaaggcgtaggactccagggcgttcttggctgacaccctctcgcggtgcacctcgtcctcggccttgtacttctccgcctcctgcacatgcggctgatctcctccttgctcaggcggcccttgtcgttggtgatggtgatcttgttgg

SEQ ID NO: 13957 - DNA, 601 bp, Homo sapiens
tcggcacgaggggaaggccatggaggcactggccacagccgagcaggcctgcaaggagaagctgcactccctgacccaggccaaggaggaatcggagaagcagctctgtctgattgaggcgcagaccgtggaggccctgctggctctgctcccagaactctctgtcttggcacaacagaattacaccgagtggctgcaggatctcaaagagaaaggccccacgctgctgaagcacccgccagctcccgcggagccctcctcggacctggcctccaagttgagggaggccgaggagacgcagagcacactgcaggccgagtgtgaccagtaccgcagcatcctggcggagacggagggcatgctcagagacctgcagaagagcgtggaggaggaggagcaggtgtggagggccaaggtgggcgccgcagaggaggagctccagaagtcccgggtcacagtgaagcatctcgaagagattgtagagaagctaaaaggagaacttgaaagttcggaccaggtgagggagcacacgtcgcatttggaggcagagctggaaaagcacatggcggccgcaagcttattccctttagtgagggttaat

SEQ ID NO: 13958 - DNA, 280 bp, Homo sapiens
atattttatttaatgtagtctcactctgttgccctggctggactgcagtggcatgatctcatctcactgcaacctctgcctcctgggttaaatcgatttctggctaatttttgaattcttattaaagatggggtttcaccatgttggccaagctgctctcaaactcctgacctcaagtgatccacccgccttggcctcccacaactgctacgattacaagtgtgatccaccgggcctggccaaattgcttcattttttatttctccatacttcctacata

SEQ ID NO: 13959 - DNA, 512 bp, Homo sapiens
  misc_feature 7, 13, 16, 20, 41: n = A,T,C or G
cgacagnaggggnagnaggnagccacttacggggcctcagnaatactgagttgaaggaaaagggcctttctctacctgccactaatgagactaaagttgttataaatatgtgccttatgatgaaaggggacaaccttatgatacagaattaacgctcacctcttgcatataaaaccagaatgaattgtgaaacaaatctctaaatgtaggcttctctttaaatcagatttactcaggccgggcgtggtggctcacgcctgtaatcccagcactttgggaggctgagacaggtggatcacctgaggtcaggagttcaagaccatcctagccagcatgatgaaaccccatcgctactaaaattcaaaaatcagctgggcgtggtggtgcacacctgtaatcccagctgctgcagaggctgaggcaggagaattgctcgatcccaggaggtagaggttgcagtgaacagagatcgtgctactgcgctcctgggtgacagagtgagactccatctc

SEQ ID NO: 13960 - DNA, 743 bp, Homo sapiens
  misc_feature 1, 3, 4, 11, 28, 183, 635, 640, 678, 685, 694, 707: n = A,T,C or G
ntnnggagggnagcgtgacacgcccttnccttgaggaccatgaaccgcagccgccaggtgacgtgcgtggcctgggtccgctgcggcgtggccaaagagacaccagacaaggtagagctgagtaaagaagaagtaaaacgcctcattgctgaggcaaaggagaaattgcaagaagaaggtggnggcagtgatgaagaggagacaggcagtccttcagaagatgacatgcagagtgcacgcacccaggcacgcccaagagagcccctggaggatggtgacccagaggatgacaggacgcttgatgatgatgagctggctgagtacgacttagataaatatgatgaggaaggtgacccagatgctgagactcttggtgaatctctcttgggtcttacggtctacgggagtaatgatcaagatccttacgttactctgaaagatacagaacaatatgaacgtgaagatttcttgattaagcccagtgataatcttatagtttgtggccgagctgaacaggaccagtgcaatttagaggtgcatgtttataatcaagaagaagactctttttatgtacaccatgatatactcttgtctgcatatcctctgagtgtggaatggctgaattttgatcctancccanatgattctactggaattactttgctgtaggaacatganccctgtnttgaagtgnggaccttgattantggctcttaaagccatcttccctcggagtaacttct

SEQ ID NO: 13961 - DNA, 473 bp, Homo sapiens
cacaaacatccagagtttattgctcttcaccatggaaaaaaagtctcttcccgatgggtatttacaaagcggggagatggagtgtgaaattaaccagtgttgaaatcgtaccacccattcacatcttcaggacagtggcaggaacagcgccgtatgcttgagggtgctgtggtcacagctcgcggccccggccaccgaggcccagttcccttccagtagtgggcagctcagtgaggctggatagaaagtctgggcaggcagtgggtatgcaattgaagcaagaagagaaaggagatgttcagagaaccaaaggcgcccttgtgaaggttccatctgtctcacaggaggttctgaccgacagctgtgggctccagattgtaccgcactcccatctcagctctgggccagcctggctccactcagctcatccaggctaccttcccttgctcaaaacccacctcgtggatgtggga

SEQ ID NO: 13962 - DNA, 415 bp, Homo sapiens
  misc_feature 310: n = A,T,C or G
tccaccgcggtggcggccgctctagactagtggatcccccgggctgcaggtcgtcgccgacgatcccttcgcgcctgtactccttgctgttccgcaaaacttccacctttgccctcaccatcgcagtgggcgccctgttcttcgagcgagccttcgatcatggcgcagacgcgatctacgagcacatcaacgatgggaaactgtggaaacatataaagcacaagtatgagaacaacgagtaacaccctgcccctgtgggacccgaaggaacagtcgccggtcagctgtttgcctggagttggggcctcancctaaggatgagtttcaagttgccgttcaccgaccgccagtgtgtgggcaagctatggctccactgtacaaacagactcacttctgctgtgtttgagtacagctg

SEQ ID NO: 13963 - DNA, 489 bp, Homo sapiens
tggactccaccgcggtggcggccgctctagaactagtggatcccccgggctgcaggaattcggcacgagagcttgtctgccatccccaaattatgtggtcgctgaccggaccgaatgtttcatcactggctggggagaaacccaaggtacttttggagctggccttctcaaggaagcccagctccctgtgattgagaataaagtgtgcaatcgctatgagtttctgaatggaagagtccaatccaccgaactctgtgctgggcatttggccggaggcactgacagttgccagggtgacagtggaggtcctctggtttgcttcgagaaggacaaatacattttacaaggagtcacttcttggggtcttggctgtgcacgccccaataagcctggtgtctatgttcgtgtttcaaggtttgttacttggattgagggagtgatgagaaataattaattggacgggagacagagtgacgcactgactcacct

SEQ ID NO: 13964 - DNA, 584 bp, Homo sapiens
aacgggattcagggtcagacggtgaggatgatgtaaatgagcaacactccggatcagacactggaagtgtagaacgtcattcagagaatgaaactagtgatcgagaagatggcctccccaaaggacatcatgtgacagactctgagaacgatgagcccttaaatcttaatgctagtgactctgaaagtgaggagcttcacaggcaaaaggacagcgactctgaatctgaggaacgtgcagagcctcctgcaagcgattctgaaaatgaggatgtcaatcagcatgggagcgactctgagagtgaagagaccaggaaattacctggtagtgactctgaaaatgaggaacttcttaatgggcatgcaagtgactcagaaaacgaagatgttgggaagcatcccgccagtgattctgagattgaggagctccagaagagtcctgctagtgactctgaaacagaagatgctctaaaacctcaaatcagtgactctgagagtgaggaacccccaaggcaccaagccagtgactccgaaaatgaggagcctcccaacctcgaatgagtgattctgaaagtgatgagcttc

SEQ ID NO: 13965 - DNA, 794 bp, Homo sapiens
  misc_feature 2, 13, 14, 15, 19, 22, 25, 26, 33, 44, 46, 53, 63, 73, 85,650, 670, 674, 699, 715, 716, 721, 726, 728, 729, 747, 759,761, 764, 766, 772, 791, 792: n = A,T,C or G
anttacttgggtnnnaaanccnctnntttgttncttttggccgnancggcctncggctgcganagtagacagnagggacactagnatatgaactctacccagtatcagtaaaccaataaaaatgttttgctttataaaatgctgtgttgcttggcagcttcaaagtcagcattgactgttacggatcttggtctaagttaaaagattagtggcttccagtagaaaatgaaaattgctttacaaatacaaatgggttctgttaataatacagagaaaagctaaatgttattttagcatccagtcttcatacttcatttatggtataaaattttttatttattcttttaataactttttaaatagtaatctcattttaaacataaactgaggaccagaatattaagcagtgttcatcaagatcgtacagtttaatagatttgaaccaggtaaagccaagattcaatattaggtctgacaaaaagctttttcaacaaagtaactctgcttcttttctactgttcatttaaaacaaaacagataaacagaccagctatcatttgggatgggagagcagaaaatttgaggaaagtaaactcaaatgtgtaaatactctaatattatgctgaaaatagatcgctttatttttctangtgaatacagagtgagttgntcantatacagatgtttaattgggactanttaggattatgacctnnaaaanaatantnnaatgcctttcaggagccnggcccggggctncnccngnatcccncttttgggaaccaggcggnnat

SEQ ID NO: 13966 - DNA, 752 bp, Homo sapiens
  misc_feature 549, 683, 704, 716, 719, 723, 728, 729, 734, 735, 736, 737,738, 741, 742, 743, 744, 745, 749: n = A,T,C or G
gggggacactactcccagctcctggctgacttctagtcttctggttgaagctgcgcctttagatgacacgaccctacccacccctgtttccagcggatgcccgggcctggagcccacagaattcttccagtccctgggtggggacggagaaaggaacgttcagattgagatggcccatggcaccaccacgctcgccttcaagttccagcatggagtgattgcagcagtggattctcgggcctcagctgggtcctacattagtgccttacgggtgaacaaggtgattgagattaacccttacctgcttggcaccatgtctggctgtgcagcagactgtcagtactgggagcgcctgctggccaaggaatgcaggctgtactatctgcgaaatggagaacgtatttcagtgtcggcagcctccaagctgctgtccaacatgatgtgccagtaccggggcatgggcctctctatgggcagtatgatctgtggctgggataagaaagggtcctggactctactacgtggatgaacatgggactcggctctcangaaatatgttctccacggggtagtgggaacacttatgcctacggggtcatggacagtggctatcggcctaatcttaccctgaaaagcctatgaccttggccgaaggcttttgttatgccctcacaaaacagctntctggaggcgttgcatttgtncaatgaagaaanggntggngaaannaaaannnnnatnnnnnaccngtg

SEQ ID NO: 13967 - DNA, 417 bp, Homo sapiens
tatgacgtcgcatgcacgcgtacgtaagcttggatcctctagagcggccgcctactactactaaattcgcggccgcgtagaccaacaacaaaattatgtgcctttgcaacaacatggtaagaagctagaggccatgatctaagtgaattaacacaggaacagaaaaccaaatactgcatgttctcacttataagggggagctaaacattgagtacacatggacatgaagatggcaacaatagacactgtagcctacttgaaggtggagggtaggtggaacgtaaggattgaaaaactgcctattggctcaatacctgggtgacaaaatcatttgtacatcaaagcccagcgacatgcaaattactcatgtaacaaacctgcataggtactccctgaatctaaaataaaagttagaag

SEQ ID NO: 13968 - DNA, 481 bp, Homo sapiens
tttgtacaaaaaagcaggctggtaccggtccggaattcccgggatatcgtcgacccacgcgtccgctgttgaattcagtttgcttatgttttgttgagatttttttgcatctatgttcatcaaggatattggtcagtagttttcttttcttgtagtgtctttgtctgcttcggtatcagggtaatgctggccttgtaaaatgagtttggaagtgttctctaacttttcggaagagtttgaaaaggattggtgttagttctttttttaaatgcttggtcatctggttctgggctttttgttgttgtttttggaagatttttaatgactgtttcaatcttcttcctagttataggtctattcagattttctatttcttcatgattcaatcttattagcttgtacatgtctaggaatttatacatttcttccaggtcatctaatttgttgaggtacaattgttcatagtagtttattatgatcc

SEQ ID NO: 13969 - DNA, 670 bp, Homo sapiens
gacactatagaacaagtttgtacaaaaaagcggctggtaccggtccggaattcccgggatatcgtcgacccacgcgtccgcccacgcgtccgagaaattctatgaggcattctctaaaaatctcaagcttggaatccacgaagactccactaaccgccgccgcctgtctgagctgctgcgctatcatacctcccagtctggagatgagatgacatctctgtcagagtatgtttctcgcatgaaggagacacagaagtccatctattacatcactggtgagagcaaagagcaggtggccaactcagcttttgtggagcgagtgcggaaacggggcttcgaggtggtatatatgaccgagcccattgacgagtactgtgtgcagcagctcaaggaatttgatgggaagagcctggtctcagttaccaaggagggtctggagctgcctgaggatgaggaggagaagaagaagatggaagagagcaaggcaaagtttgagaacctctgcaagctcatgaaagaaatcttagataagaaggttgagaaggtgacaatctccaatagacttgtgtcttcaccttgctgcattgtgaccagcacctacggctggacagccaatatggagcggatcatgaaagcccaggcacttcgggacaactccaccatgggctat

SEQ ID NO: 13970 - DNA, 567 bp, Homo sapiens
tgacactatagaacaagtttgtacaaaaaagcaggctggtaccggtccggaattcccgggatatcgtcgacccacgcgtccgaaaatattcccatgaattatgtccagttcttcttggaaaaaaatttggttttgaatgaacctgcaaagcatcctgcagcgtgagcagctcctccacctggagctccgaagcatcttctcaggccaaagcggcattacccgtgaatctgtcttctccgccacagcatggtttgaggcgcagtctgttaatatagctgggccatgtcagtgactgttgtgtttgtggggtcaggtggggggcatggtatttgcaaaaaaaacaaattatggctaatttattattttgttgcagtggggttaactgtaaactcatgtaagagtctgtgatttcctcattggttgatctctctctctgtaatcctcattgcaaattttcaccaggacagcgttttttgattagaggggagctctggcacagtatgctttaatttagcaggaacttccagatgatttaaattctcgatgctgtgatgacacacatatgat

SEQ ID NO: 13971 - DNA, 138 bp, Homo sapiens
cagtgtatggaggaatggtaagtactttacagctgttgtacagggcagcatgtcctgaaaggggctgcaagaaatgctgattccaagggatgtgtgccagttctctgggggaggaagaaaggctctgtagcagaaaga

SEQ ID NO: 13972 - DNA, 483 bp, Homo sapiens
tcggcacgagggttttcatgaccaagttttttacatcagatttattattttggacccttaaaggaatataaattgcaagagagattttgatcagtgtaagaattactagatggccttatttatttccttctttattattgtacttcttatcttttattaatgttttctttctctaagatatatttgaaagccaggcatggtgacacacccctgtagttccagctactcaggacactgaggcaggaggattgtttgagctcatgggttcgaggctatgtagtacataatcacacctatgactagccactgcattccagcctgggtaacatagcgagcccctgtctcttaaaaaacaaaagatgtggccaggcatggtggctcacacctgtaatcccagcactttgggaggctgaggtgggcggatcacttgaggtcaggggttcaagaccagcctggacaacatggtaaaaccctgtatctaca

SEQ ID NO: 13973 - DNA, 304 bp, Homo sapiens
aagcttgcggccgtctgcgcggcgccgccccgtggtcggatcctgggcggcagagaggccgaggcgcacgcgcggccctacatggcgtcggtgcagctgaacggcgcgcacctgtgcggcggcgtcctggtggcggagcagtgggtgctgagcgcggcgcactgcctggaggacgcggccgacgggaaggtgcaggttctcctgggcgcgcactccctgtcgcagccggagccctccaagcgcctgtacgacgtgctccgcgcagtgccccacccggacagccagcccgacaccatcgaccacg

SEQ ID NO: 13974 - DNA, 133 bp, Homo sapiens
catctcccagcccctatggtttcacatagacgtgcagtgtgaaccaaagcaagactgaatgtgactgtaaataattctgttcatcatttcactccgtgcagttctctgaattgagagatgcacctcttaaacc

SEQ ID NO: 13975 - DNA, 638 bp, Homo sapiens
gtacaacataaataacaaaggtgctaatttcaaagacaggtttcaaacaatgagaataagaatatattatttcatatcaggcaataataaccttagcccaaatacttttaacatctaaagtgcattaattgacttccttaggaattttcctaaggaccaaaggtagatacaaatggcctattttaaatagtaatattactccatgttcacagacacttaaaggcaatcactattcaacatacaattgtggaaattactgatttttagttctcagaattagagttccctttgtttttcctcccaggcaaaggaaagcttgatttgctctggggttgagaaagtttactggctaataaagtgaatggttcaatcagagttttccgatctgtaacagtcacctcccacagtcttactttctcactttttgcccactgctgtgccacttcagcgtccacttgtctctgctcagaaaggtcgattttgtttcctaataccacaattgctacctcttttttgtctttgaacttatcgatttctttcttcagaagctccactctttgaaaggattcaaggttattcacactgtacacaagaacgaagccatcagcaaatgaaaaataatgctttggcagctccaa

SEQ ID NO: 13976 - DNA, 474 bp, Homo sapiens
agtctcgaaaggcactctgtcacgtgtacacaggaaagggccctgacaagaggatgggactgcagttgtggctgccagagtcttgctttgtcgcccaggttggagtgcagtggcacgatctcggctcagtgcaacctccgcctcctgagttcaagtgattctcctgcctcagcctccctagtagctgggattacaggacaaggagagggacaaattccttcttggcatccttatggccctgtgacctgctaatgaatgctgactctgagctgctactagaatttggtttccttgtggcttcccaggaattggtctcactctgctcactctgtctcccaagctggagtgcagtggtacagtcacggctcactgcagcctccacttcctggactcaagtgatcttctcacttcagccttctgagtagctgggactacagccccctctgcagctcttcatgggggtccactcaagtc

SEQ ID NO: 13977 - DNA, 495 bp, Homo sapiens
  misc_feature 357: n = A,T,C or G
tacgcctgcaggtaccggtccggaattcccgggtcgacccacgcgtccgatttagaactgaacacgcctcacactagccacaagacccagaccaataactcccttgccctctctgggcctcagtgactttgcctcaaggtagttgtgaggaaggtgagcaaaacagggaaagagtcaccaatggatttggatttttaagatattgaaatcccaggcacaggcgcggtggctcacgcctgtaatcccaacactttgggaggccaaggcaggcggatcacaaggtcaggagatcgagaccatcctggctaaaacggtgaaaccccgtctctactaaaaatacaaaaaaattagccgggncgtggtggcgggcacctgtagtcccagctactctggaggctgagacaggagaatggcttgaacccgggaggcagaggttgcagtgaaccgagattgtgccattgcactccaacctggttgacaagagcaagacttcat

SEQ ID NO: 13978 - DNA, 364 bp, Homo sapiens
taatacgactcactatagggaatttggccctcgaggccaagaattcggcacgaggtttgctgcgctgaacctgtacacagacatcatgaacatcttcctgtacatcctcaccatcattggccgagccaaggagtatccgagctccagctcgctgtgcccgctcaggtggcacggctggcctggaccctgcccctggcacggcagagccagctgaacttcccctctctcttgttcccaggcacaggctagggaaaaggatgcctctctccaaccctcctgtatgtacactgcacatacttccatttggacccgctgtggccacagcatggaccctttagtcctcccgcccccgccaaggggcacc

SEQ ID NO: 13979 - DNA, 669 bp, Homo sapiens
acgccagctcgaattaaccctcactaaagggaacaaaagctggagctccaccgcggtggcggccgctctagaactagtggatcccccgggctgcaggaattcggcacgagtcccaccccatttagcccgtgggattcttggatcattgaacagcgatggggtcctcaaaatgaagagagttgacttctgccaaaaggcatgtgatgctcaagtgattaatttgaaaaacaaaagtaacatctacagaggagtaaacattccaggggtgcctgcatttgacagatctgttccctggggtgaatgtttaatctagagtgtgggaaggagctattcctccatagtatcagcattcctccttactttgctatgtcctccctaacactctcattcccatctttgctgttgtttcaatcaataacaaaagaggccaggcgcggtggctcacgcctctaatcccagcacgttgggaggccgaggcaggcggatcacctcaggtcaggagtttgagaccagcttgagcaacatggcaaaaccccgtctctattaaaaatataaaaaattagccaggcatggtggtgggggcctgtaatacaagctacttgggagactgaggtgggagaatggcttgaacccaggaggtggaggttgcagtgagctgagatcgcgccg

SEQ ID NO: 13980 - DNA, 512 bp, Homo sapiens
tggtacgcctgcaggtaccggtccggaattcccgggtcgactactactactaaattcgcggccgcgtcgacagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggccgagaagaaggccactgatgctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggtcatcgaaaaccgggccatgaaggatgaggagaagatggaactgcaggagatgcagctgaaggaggccaagcacatcgctg

SEQ ID NO: 13981 - DNA, 280 bp, Homo sapiens
atattttatttaatgtaccctcactctgttgccctggctggactgcagtggcatgatctcatctcactgcaacctctgcctcctgggttaaagcgatttctggctaatttttgaattcttattaaagatggggtttcaccatgttggccaagctgctctcaaactcctgacctcaagtgatccacccgccttggcctcccacaactgctacgattacaggtgtgatccaccgtgcctggccaaattgcttcattttttatttctccatacttcctacata

SEQ ID NO: 13982 - DNA, 681 bp, Homo sapiens
  misc_feature 617: n = A,T,C or G
agagcaacatgcccaagttttattgtgactactgcgatacatacctcacccatgactctccatctgtgagaaagacacactgcagtggaaggaaacacaaagagaatgtgaaagactattatcagaaatggatggaagagcaggctcagagcctgattgacaaaacaacggctgcatttcaacaaggaaagatacctcctactccattctctgctcctcctcctgcaggggcgatgataccacctccccccagccttccgggtcctcctcgccctggtatgatgccagcaccccatatggggggccctcccatgatgccaatgatgggccctcctcctcctgggatgatgccagtgggacctgctcctggaatgaggccgcccatgggaggccatatgccaatgatgcctgggcccccaatgatgagacctcctgcccgtcccatgatggtgcccactcggcccggaatgactcgaccagacagataaggatagaggggaggccttattgtatcggttttatattacctgttctgcttcaccaggagatcatgctgctgtgatactgagttttctaaacagcataaggaagacttgctcccctgtcctatgaaaganaatagttttggagggggagaagtgggacaaaaagatgcagttttcctttgtattgggaaattgc

SEQ ID NO: 13983 - DNA, 689 bp, Homo sapiens
  misc_feature 5, 181, 214, 219, 223, 257, 279, 297, 298, 307, 309, 312,320, 350, 391, 397, 448, 461, 474, 485, 511, 537, 544, 578,630, 648, 657, 672, 674, 680, 684, 685, 688, 689: n = A,T,C or G
acagnaggggagcattctgttttttgatattgagtattttataaatcctttattcttctgcactataatttctgacaatcctcccgagcttttgaggctataggattacttgtgtctgtgatttcttgtgtcacagatttctgtgattgggagagcggactactgtttttttttttttganacagggcctcaatcccattgcccaggctagggngcaanggcncaaactcggttcactgcatccttaacctccctgngctcaggcaatcctcccacctnagcctcccaagtagctgnnactataggngngcnccaccacncctggctaatttttcaaatttttggtaaanacggggttttgccatgttgcccaggctggtctcaaactccngggctnaagcaagccacctgcctttgcctcccaaagggctgggattacagggatganccaccatgcccancctctgtttactntttttaactgnaagctgttgcataaaactgctggcanaagttccccatattcccattctattngccccanccatttatattttctgcttctaacataaaataanctggggatgggggaagcataaaaaaccaaaatccaagtttattggatttgtntgcaaactaaaaaaaaancctctgagngagggcctgcttctntntcccanttcnnacnn

SEQ ID NO: 13984 - DNA, 766 bp, Homo sapiens
  misc_feature 1, 8, 191, 192, 219, 312, 327, 374, 392, 428, 459, 477, 521,530, 556, 562, 582, 589, 598, 613, 619, 625, 637, 639, 645,654, 662, 663, 685, 691, 711, 718, 721, 728, 735, 736, 748: n = A,T,C or G
nggcaggnaatggcagtgcgtattttctggctgaaaagtaaagcatgtatccaccgctttctcatagcctcgaaacatggagaaaagcaacttgcttttgccttggcaagcatgctaacctaagttaattcaagttttttttaacttaccctttccttcactggaagatttttccataagagaattccatnntgtttcaaaaaaataattatagggggncccttccaagttctttgaaagattcataaccaactattcactattataacatgtttcccagtgtaaatgagtaaggaaaaaaaagtgtaacangtgcgtgcagatgangagtgaccctcatatttaagttattttatattttgactggacattgntcaaaaaggtgctttaanggacacttgttggttgtctgcccagcatctttcaanaatatccctcctggcctccacatgggttggngcagggccatgtgtgaanacagcatgagtcttaacccctcttttatttttattttttgaaanaaagcctcnctctttttgccaagctggaatgctgnggcccnattttggttactggaacctnccctccnggttcaagnattctcctgcctcanctgccngtactngaattccagggngncccccntgcccactngttttttnntttttataaaaaagggttactntttgcnagctggctgaacccgacccngggaccnccncccaccnccaaagnngggtaaagggtnaccctggccggcttaccc

SEQ ID NO: 13985 - DNA, 505 bp, Homo sapiens
  misc_feature 413, 443, 505: n = A,T,C or G
attgactcagcaatgcagggctggcacccatcagcttcaaaccacatcttatcgcatccactcctgtccactcccgtccactttgccctcttccaggctgaaatcttgctttcaggcaagggcttccggccagccttgcattagttctcagctatggtcttctgaacccagtcctggatggaagtcaccttcacatacacaccatactcagccacagcacagctcttatcaaagcttaagatcccagtcgcataccaggtgtcctcctccaggtcgtgaacggcaaaggcactgcccgcatcgccatagcaggtgtcttcttggtacttagacatgccagcacagaaggtgtgttcattcagtatggggctgcacccctacagggctcttcggtgtcttcttttcggggactntgctgccttcataatgccttatgcattggncttgggtcagccacaggaggcattgacatacttcagatggtcagtaaatttaaaattgggcn

SEQ ID NO: 13986 - DNA, 657 bp, Homo sapiens
gtttgtttaattttgtattttaataaaagcaaatgcaatgtaacaaaagcgtgttgaagcatatcatggtttaacttactgctcccaccacaaaatattttgtcttttacttatcgtttcagaaatcagtaccattaaagccttaaacagaaaactaattccaatctgaaaaaggtacaaaaaggcacataaaatcccagtgcttctgtactgtaaaattcaagtgtaactgagctcagtgtttttccaaacagtatggatcactgatattccctctgagcccaaattggtttgcagcctatgccaaagcctccagcaagcactgtgctagtagactacaaagttaaagcctagcttctgaatgctttttgggaatatcagttgaaattgtttgtacttgtccaaaaaccaagttcaccctgaagttcagtcatcacctccaccatacatgtcagaaagtttcttgaaccgtggcccccagtcgttcaggtaatcatagtcctgctcaccaccactacttgaggaattaagggagctcaaggacccagcagtggagccactgccttcatagtcaaacactaacagggagtcatatggtggagctgtggggtcatttgcagccgctttaaggccctcattaatgaagtccccaatgtc

SEQ ID NO: 13987 - DNA, 412 bp, Homo sapiens
  misc_feature 231, 250, 262, 268, 321, 336, 344, 356, 365: n = A,T,C or G
accccaacttggaggacacctacagctccgaggagactgtggaccaccagcctgtccacctgagggtcatggacactgcagacctggacacccccaggaactgcgagcgctacctgaactgggcccatcccttcctggtggtgtacagcgtcgacagccgccagagctttgatagcagcagcagctacctgggagctgctttgccttgcacgcgaaggagacacagcgcanattccctgccctgctgctnggcaacaagctngacatnggttcagtacaaggcaagtcaccaaggcagagggtgttgcttttggaaggcangttttggggtgcctntttttttngaagtttttttncctgttttnggaatttttaagcaagttgcagcatgttttttccacgaaggcaattt

SEQ ID NO: 13988 - DNA, 461 bp, Homo sapiens
tatgacgtcgcatgcacgcgtacgtaagcttggatcctctagagcggccgcctactactactaaattcgcggccgcgtcgacggtatacctgtgtgacaactggggaggacactttccttgtgccctcaaatcagttgtccctccagatgagaagcactggaatgatctggctttggaatttcactatatgaggtctctgccgaagcatgagcgattggtggatctccatggttcagtcattgactacaactatggtggtggctccagcattgctgtgctcctcattatggagcggctacaccgggatctctacacagggctgaaggctgggctgaccctggaggtcgacgcggccgcgaatttagtagtagtagagtcgacccgggaattccggaccggtacctgcaggcgtaccagctttccctatagtgagtcgtattagagcttggcgtaatcatgg

SEQ ID NO: 13989 - DNA, 452 bp, Homo sapiens
tggtacgcctgcaggtaccggtccggaattcccgggtcgactactactactaaattcgccgccgcgtcgacgtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtaccatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgc

SEQ ID NO: 13990 - DNA, 658 bp, Homo sapiens
tccaccgcggtggcggccgctctagactagtggatcccccgggctgcaggaattcggcacgaggcggaaggtctggagtgggtggggcggagtgggagggacgcctagagatggcaggaggaagacctgggcgctcttaaccacccccaacgcccttgtctgcatgtctttttctctgtctcctccttttctgtttcttctcccagacaggtgaagaaacaagaaaactaagaaatccgagcggttggagggggagtctgtgtggatgggatggggacgccgggggaggggctgggccgctgctcccatgccctgatccggggagtcccagagagcctggcgtcgggggaaggtgcgggggctggccttcccgctctggatctggccaaagctcaaagggagcacggggtgctgggaggtaaactgaggcaacgactggggctacagctgctagaactgccacctgaggagtcattgccgctgggaccgctgcttggcgacacggccgtgatccaaggggacacggccctaatcacgcggccctggagccccgctcgtaggccagaggtcgatggagtccgcaaagccctgcaagacctggggctccgaattgtggaaataggagacgagaacgcgacgctggatggcactgacgttc

SEQ ID NO: 13991 - DNA, 599 bp, Homo sapiens
ataaatggatgttgctcctttgtatttttagcttccctatttgcttaaaagtacaggctccctaagagaggatggagagggagagactgaattgttagtaggtctaaacatcaaagaaaacatttttattagttacttatggaaaatcatctattacaatgataaccttcaagtgacttccattatggctggacaggcggtgagctcagtggattgcagtggtgtgctggtgattttgcacagtgagctctgcggaaggggtcaggctcaactgctgatgtgtctcacacgtagcagacaaggggtgtctgactggcttcttttgcctcaagatggtgtatgtcgtaagtgatgcaatcagctgtctgctttttaaggttgggattgtgctgactttgggattaacatgagcttctttagcaaccaagcatgaacttgattaagaccagaagtttgggagatgagtcctggcattatgtctaggactaaagcagtggctttgtatagcaagctgagtaaaggttgacatattccaaaacccttctttttaaaatgaaaaaggatggagagaaggatggaaagcctggacttaaaccttt

SEQ ID NO: 13992 - DNA, 192 bp, Homo sapiens
ttttaatgaagacaatttgtaaagtaatactgttatgtatatgctaaatgttggtaaatactaattaatttccatcatttgtagacttgttttgcaatgggatatatttttacttataataccaatttaggctgggcgcagtggctcacgcctgtaatcccagcactttgggaggccaaggcaaacggatca

SEQ ID NO: 13993 - DNA, 474 bp, Homo sapiens
  misc_feature 347, 358, 376, 395, 409, 418, 435, 443, 454, 456, 458, 465: n = A,T,C or G
ggggatgaatgttcagttgaagtaataccaaaactaaaggattagaagcaaagtatttgaatgtatagagctaggcatgagaacccagaacgtacacctaatgacagagcctgtgcgttccctgaattttgtaccaatcaaaacccttcacctgtcctgccatttcccttgctgctgcctcattgggtggaagtggccacctgtagttttccagaaaattcacagagcaccgctggctgagctggtgtcccattaccactccaggcgtatgctggtacatgtaccaaattcacacagaatgtctggggcactcgggggagacactgtgggaacaaaaagaccaacanaagccctcctntttcaaactcgctgtgcnacccaaaaggcacctgtgntttctggtggtgangcagggcanatttacatttaagaagnctactttnagctgatgcgngntnatgctgnatcccacct

SEQ ID NO: 13994 - DNA, 416 bp, Homo sapiens; identical to SEQ ID NO: 11221

SEQ ID NO: 13995 - DNA, 818 bp, Homo sapiens
  misc_feature 5, 9, 16, 27, 47, 57, 60, 68, 643, 712, 728, 732, 748, 749,755, 768, 772, 774, 775, 777, 778, 779, 784, 799, 801, 805,809: n = A,T,C or G
gaccntacnataccgncttgcttgttncttttggccgcagcggcctncggctgcganagnacgacagnagggggccggtggcgggactctggggaaaatggctgcgtcttcgagtgggaacttatagaaatgctggcaatttcaagaaaccaaaagttgttacaggctggagaggaaaaccaggtcctggagttgttaattcaccgagatggggaatttcaagaactaatgaaattggcacttaatcagggaaaaattcatcatgaaatgcaagttttagaaaaagaagtagagaagagagacagtgatattcagcagctacaaaaacagctaaaggaagcagaacaaatactggcaacagctgtttaccaagcgaaggagaaactcaagtcaatagaaaaagcaagaaaaggtgctatctcctctgaagaaataattaagtatgcacataggatcagtgcaagtaatgctgtatgtgctccactgacctgggttccaggggacccccggagaccctacccaactgatttaaagatgagaagtgggttactgggtcagatgaacaatccttccactaatggcgtgaatggccatttaccaggagatgcacttgcagcaggaagattgccagatgtccttgctncacagtatccatggcagtcaaatgacatgtcgatgaatatgttaccaccaatcatagtatgacttttgntggacctcctggcctntaanaaatgaagatgatgtnnagattntgtcacggctctnagcngnntnnngagtntgattgaaaccttanancatntccnattgatctg

SEQ ID NO: 13996 - DNA, 486 bp, Homo sapiens
tgacactatagaacaagtttgtacaaaaaagcagctggtaccggtccggaattcccgggatatcgtcgacccacgcgtccgcccacgcgtccggcgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgc

SEQ ID NO: 13997 - DNA, 25 bp, Artificial Sequence
  Primer
ggagtgaacaagaagcccagattgc

SEQ ID NO: 13998 - DNA, 22 bp, Artificial Sequence
  Primer
aaggtcgctctgcttcacgcca

SEQ ID NO: 13999 - DNA, 24 bp, Artificial Sequence
  Primer
tggatgaagttggcgaaggacacc

SEQ ID NO: 14000 - DNA, 23 bp, Artificial Sequence
  Primer
tcggaggaggttttcgggcttgg

SEQ ID NO: 14001 - DNA, 24 bp, Artificial Sequence
  Primer
cgccagaacttgttgaaggtcagg

SEQ ID NO: 14002 - DNA, 23 bp, Artificial Sequence
  Primer
caggctggtgtggttggcgtaca

SEQ ID NO: 14003 - DNA, 25 bp, Artificial Sequence
  Primer
actgagaaacttgtccagaaactcg

SEQ ID NO: 14004 - DNA, 23 bp, Artificial Sequence
  Primer
cgtcctcgtccagagtctccagc

SEQ ID NO: 14005 - DNA, 21 bp, Artificial Sequence
  Primer
aagtttctcagtgctggcgtg

SEQ ID NO: 14006 - DNA, 21 bp, Artificial Sequence
  Primer
guuucucagugcuggcgugtt

SEQ ID NO: 14007 - DNA, 21 bp, Artificial Sequence
  Primer
cacgccagcacugagaaactt

SEQ ID NO: 14008 - DNA, 21 bp, Artificial Sequence
  Primer
aagcagagcgaccttcccaga

SEQ ID NO: 14009 - DNA, 21 bp, Artificial Sequence
  Primer
gcagagcgaccuucccagatt

SEQ ID NO: 14010 - DNA, 21 bp, Artificial Sequence
  Primer
ucugggaaggucgcucugctt

SEQ ID NO: 14011 - DNA, 21 bp, Artificial Sequence
  Primer
aactggaagcgcgtgatgatc

SEQ ID NO: 14012 - DNA, 21 bp, Artificial Sequence
  Primer
cuggaagcgcgugaugauctt

SEQ ID NO: 14013 - DNA, 21 bp, Artificial Sequence
  Primer
gaucaucacgcgcuuccagtt

SEQ ID NO: 14014 - DNA, 21 bp, Artificial Sequence
  Primer
aagcgcgtgatgatcgtgctg

SEQ ID NO: 14015 - DNA, 21 bp, Artificial Sequence
  Primer
gcgcgugaugaucgugcugtt

SEQ ID NO: 14016 - DNA, 21 bp, Artificial Sequence
  Primer
cagcacgaucaucacgcgctt

SEQ ID NO: 14017 - DNA, 21 bp, Artificial Sequence
  Primer
aacaagttctggcgccgctac

SEQ ID NO: 14018 - DNA, 21 bp, Artificial Sequence
  Primer
caaguucuggcgccgcuactt

SEQ ID NO: 14019 - DNA, 21 bp, Artificial Sequence
  Primer
guagcggcgccagaacuugtt

SEQ ID NO: 14020 - DNA, 21 bp, Artificial Sequence
  Primer
aaggtcaagctcaagaagtac

SEQ ID NO: 14021 - DNA, 21 bp, Artificial Sequence
  Primer
ggucaagcucaagaaguactt

SEQ ID NO: 14022 - DNA, 21 bp, Artificial Sequence
  Primer
guacuucuugagcuugacctt

SEQ ID NO: 14023 - DNA, 21 bp, Artificial Sequence
  Primer
aagctcaagaagtacaccaag

SEQ ID NO: 14024 - DNA, 21 bp, Artificial Sequence
  Primer
gcucaagaaguacaccaagtt

SEQ ID NO: 14025 - DNA, 21 bp, Artificial Sequence
  Primer
cuugguguacuucuugagctt

SEQ ID NO: 14026 - DNA, 21 bp, Artificial Sequence
  Primer
aagaagtacaccaagttcctc

SEQ ID NO: 14027 - DNA, 21 bp, Artificial Sequence
  Primer
gaaguacaccaaguuccuctt

SEQ ID NO: 14028 - DNA, 21 bp, Artificial Sequence
  Primer
gaggaacuugguguacuuctt

SEQ ID NO: 14029 - DNA, 21 bp, Artificial Sequence
  Primer
aagtacaccaagttcctcttc

SEQ ID NO: 14030 - DNA, 21 bp, Artificial Sequence
  Primer
guacaccaaguuccucuuctt

SEQ ID NO: 14031 - DNA, 21 bp, Artificial Sequence
  Primer
gaagaggaacuugguguactt

SEQ ID NO: 14032 - DNA, 21 bp, Artificial Sequence
  Primer
aagttcctcttcgtgcgcgac

SEQ ID NO: 14033 - DNA, 21 bp, Artificial Sequence
  Primer
guuccucuucgugcgcgactt

SEQ ID NO: 14034 - DNA, 21 bp, Artificial Sequence
  Primer
gucgcgcacgaagaggaactt

SEQ ID NO: 14035 - DNA, 21 bp, Artificial Sequence
  Primer
aagttcgagctggagaacgag

SEQ ID NO: 14036 - DNA, 21 bp, Artificial Sequence
  Primer
guucgagcuggagaacgagtt

SEQ ID NO: 14037 - DNA, 21 bp, Artificial Sequence
  Primer
cucguucuccagcucgaactt

SEQ ID NO: 14038 - DNA, 21 bp, Artificial Sequence
  Primer
aacgaggagttctaccgcaag

SEQ ID NO: 14039 - DNA, 21 bp, Artificial Sequence
  Primer
cgaggaguucuaccgcaagtt

SEQ ID NO: 14040 - DNA, 21 bp, Artificial Sequence
  Primer
cuugcgguagaacuccucgtt

SEQ ID NO: 14041 - DNA, 21 bp, Artificial Sequence
  Primer
aaggtgtccttcgccaacttc

SEQ ID NO: 14042 - DNA, 21 bp, Artificial Sequence
  Primer
gguguccuucgccaacuuctt

SEQ ID NO: 14043 - DNA, 21 bp, Artificial Sequence
  Primer
gaaguuggcgaaggacacctt

SEQ ID NO: 14044 - DNA, 21 bp, Artificial Sequence
  Primer
aacttcatccagtacctgctg

SEQ ID NO: 14045 - DNA, 21 bp, Artificial Sequence
  Primer
cuucauccaguaccugcugtt

SEQ ID NO: 14046 - DNA, 21 bp, Artificial Sequence
  Primer
cagcagguacuggaugaagtt

SEQ ID NO: 14047 - DNA, 21 bp, Artificial Sequence
  Primer
aagctggagactctggacgag

SEQ ID NO: 14048 - DNA, 21 bp, Artificial Sequence
  Primer
gcuggagacucuggacgagtt

SEQ ID NO: 14049 - DNA, 21 bp, Artificial Sequence
  Primer
cucguccagagucuccagctt

SEQ ID NO: 14050 - DNA, 21 bp, Artificial Sequence
  Primer
aaactctacgaggccgacttt

SEQ ID NO: 14051 - DNA, 21 bp, Artificial Sequence
  Primer
acucuacgaggccgacuuutt

SEQ ID NO: 14052 - DNA, 21 bp, Artificial Sequence
  Primer
aaagucggccucguagagutt

SEQ ID NO: 14053 - DNA, 21 bp, Artificial Sequence
  Primer
aacctcctccgagactgaaag

SEQ ID NO: 14054 - DNA, 21 bp, Artificial Sequence
  Primer
ccuccuccgagacugaaagtt

SEQ ID NO: 14055 - DNA, 21 bp, Artificial Sequence
  Primer
cuuucagucucggaggaggtt

SEQ ID NO: 14056 - protein, 419 aa, Homo sapiens
MTKPRLFRLWLVLGSALMILLIIVYWDNVGTAHFYLHTSLSRPHILEPLPTQGLVEENVFTSDVDEFLDTLLSSDAKHNDLSRRKTEQPPAPAPSKPVLSHMEENVRGYDWSTHDAHQNPDRDRQQAERRSLLRDFCANASLAFPTKDRSRDDIPNYELNHLIVDDRHGVIYCYVPKVACTNWKRVMIVLSESLLDRGSPYRDPLDIPREHVHNTSTHLTFNKFWRRYGKFSRHLMKVKLKKYTKFLFVRDPFVRLISAFRSKFELENEEFYRKFAVPMLRLYANHTSLPASVSEAFSAGLKVSFANFIQYLLDPHTEKLAPFNEHWRQVYRLCHPCQIDYDFVGKLETLDEDAAGLLRFLKVDSQLHFPPSYRNRTASSWEEDWFANIPLAWRQQLYKLYEADFVLFGYPKPENLLRD

SEQ ID NO: 14057 - protein, 414 aa, Homo sapiens
MTKARLFRLWLVLGSVFMILLIIVYWDSAGAAHFYLHTSFSRPHTGPPLPTPGPDRDRELTADSDVDEFLDKFLSAGVKQSDLPRKETEQPPAPGSMEESVRGYDWSPRDARRSPDQGRQQAERRSVLRGFCANSSLAFPTKERAFDDIPNSELSHLIVDDRHGAIYCYVPKVACTNWKRVMIVLSGSLLHRGAPYRDPLRIPREHVHNASAHLTFNKFWRRYGKLSRHLMKVKLKKYTKFLFVRDPFVRLISAFRSKFELENEEFYRKFAVPMLRLYANHTSLPASAREAFRAGLKVSFANFIQYLLDPHTEKLAPFNEHWRQVYRLCHPCQIDYDFVGKLETLDEDAAQLLQLLQVDRQLRFPPSYRNRTASSWEEDWFAKIPLAWRQQLYKLYEADFVLFGYPKPENLLRD

SEQ ID NO: 14058 - protein, 357 aa, Homo sapiens
MTKRLFRLWLVLGSMILLIVYWDGAHFYLHTSSRPHPLPTGESDVDEFLDLSAKDLRKTEQPPAPAMEEVRGYDWSDAPDRQQAERRSLLRFCANASLAFPTKDRAFDDIPNELHLIVDDRHGIYCYVPKVACTNWKRVMIVLSSLLRGAPYRDPLIPREHVHNSHLTFNKFWRRYGKSRHLMKVKLKKYTKFLFVRDPFVRLISAFRSKFELENEEFYRKFAVPMLRLYANHTSLPASEAFAGLKVSFANFIQYLLDPHTEKLAPFNEHWRQVYRLCHPCQIDYDFVGKLETLDEDAAQLLLVDQLFPPSYRNRTASSWEEDWFAIPLAWRQQLYKLYEADFVLFGYPKPENLLRD

SEQ ID NO: 14059 - DNA, 518 bp, Homo sapiens
tggaataacgtgtggacactttctggtacctttttggaccttctttggtgcaaccctaattggaaaagcaataataaaaatgcatatccagaaaatttttgttataataacattcagcaagcacatagtggagcaaatggtggctttcattggtgctgtccccggcataggtccatctctgcagaagccatttcaggagtacctggaggctcaacggcagaagcttcaccacaaaagcgaaatgggcacaccacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataagtagagaaagttttaaactgcagaaattggagtggatgggttctgccttaaattgggaggactccaagccgggaaggaaaattcccttttccaacctgtatcaatttttacaactttt

SEQ ID NO: 14060 - DNA, 493 bp, Homo sapiens; identical to SEQ ID NO: 2768

SEQ ID NO: 14061 - DNA, 374 bp, Homo sapiens; identical to SEQ ID NO: 2770

SEQ ID NO: 14062 - DNA, 456 bp, Homo sapiens
gaataacagctgctctacttacctttttaccttttgatcaaccctgattttaacaaaagtaaatcatttcttaatttttgattcatcagaatgcaatagttggctaatgttcctttttagtgctgtccccggcataggtccatctctgcagaagccatttcaggagtacctggaggctcaacggcagaagcttcaccacaaaagcgaaatgggcacaccacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataagtagagaaagttttaaactgcagaaattggagtggatgggttctgccttaattgggaggactccaagccgggaaggaaaattccctttt

SEQ ID NO: 14063 - DNA, 338 bp, Homo sapiens
gtgctgtccccggcataggtccatctctgcagaagccatttcaggagtacctggaggctcaacggcagaagcttcaccacaaaagcgaaatgggcacaccacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataagtagagaaagttttaaactgcagaaattggagtggatgggttctgccttaaattgggaggactccaagccgggaaggaaaattccctttt

SEQ ID NO: 14064 - DNA, 338 bp, Homo sapiens; identical to SEQ ID NO: 3019

SEQ ID NO: 14065 - DNA, 186 bp, Homo sapiens; identical to SEQ ID NO: 3020

SEQ ID NO: 14066 - DNA, 118 bp, Homo sapiens; identical to SEQ ID NO: 3021
